United States Patent 9,958,448 (APTAMERS AND USES THEREOF) - sequence listing, part 5

SEQ ID NO: 53668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgggcgcgaattcatgtcggtgatttgcg

SEQ ID NO: 53669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgggcggtggaccatgggtacgcgtttcg

SEQ ID NO: 53670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgggctgctcttttgatggcttatatatt

SEQ ID NO: 53671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggggagtgccgggtctggtcttaccgcc

SEQ ID NO: 53672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgggggactcactggctgcggcggttatt

SEQ ID NO: 53673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgggggccacactcccgaagtccatacgg

SEQ ID NO: 53674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgggggtcaagatggggaggcacgcatcg

SEQ ID NO: 53675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgggtaagggcgaagagctcggttgagga

SEQ ID NO: 53676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgggtagcgtgttacggacggggccggac

SEQ ID NO: 53677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggtatcagggcaggtcctaggggattac

SEQ ID NO: 53678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggtcgatgtaggtgtcaataaaattgcg

SEQ ID NO: 53679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggtggcctagtaacataagggtgttagc

SEQ ID NO: 53680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggtgtgtaggggtgcctcgtccgtcgca

SEQ ID NO: 53681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggttctccgtcttaacgcctgtaaaata

SEQ ID NO: 53682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggttgagcccgctgctaagcaattgtgc

SEQ ID NO: 53683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggtttactgggctctggaaatagtcagt

SEQ ID NO: 53684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtaacagttcgagttgcatttgttgagg

SEQ ID NO: 53685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtaatacagaagacgtcgttagcctcct

SEQ ID NO: 53686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtagagttgggggttttctcacataatc

SEQ ID NO: 53687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtaggttggcagcggacatatcgggatg

SEQ ID NO: 53688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtatcccgattcgtgtgtttggggtgtc

SEQ ID NO: 53689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtatctccattcctccacgtgagactat

SEQ ID NO: 53690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtattcgcaccatttgcagggccctttt

SEQ ID NO: 53691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtcaatggcttgttccgcttttgttctt

SEQ ID NO: 53692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtcacggttggcaagttcgtccgctcac

SEQ ID NO: 53693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtccagttcaactttcctacgctcgtgg

SEQ ID NO: 53694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtcgatacggctgcagtatcagatggat

SEQ ID NO: 53695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtcggttaacgtcatgcaatgggagtcc

SEQ ID NO: 53696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtctaagacgttaggacgtgtgtcttgg

SEQ ID NO: 53697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtctgactcgtcccgctaacgctggcat

SEQ ID NO: 53698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtctggcggaatgatcgaggagattcga

SEQ ID NO: 53699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtctgtatctatgcaaaggaatggcaca

SEQ ID NO: 53700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtgcgtggagtctcgtgagattatacct

SEQ ID NO: 53701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtggttagtcgccgacatggttcccttg

SEQ ID NO: 53702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgttacttcgccaccgcaatgtgtatcga

SEQ ID NO: 53703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgttcctcttcatgtccggcattatcctt

SEQ ID NO: 53704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgttctgctacgttatggaatcaaggctt

SEQ ID NO: 53705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgttgggcgatttttgttgacatcatggg

SEQ ID NO: 53706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgttggtacctgatggacgggtgtctgtg

SEQ ID NO: 53707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgtttctaggcgctcattgacgctaagtc

SEQ ID NO: 53708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttaacggcgtactactggcgggggtggct

SEQ ID NO: 53709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttaattagagcagtcttgttatcgatgag

SEQ ID NO: 53710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttacagccctgttatcgaataatacctcg

SEQ ID NO: 53711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttacctcatgtggttcttagcagacctat

SEQ ID NO: 53712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttacgataccgcatcttaatagcgaccgg

SEQ ID NO: 53713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttacgccaccacatggaaaagatctcacg

SEQ ID NO: 53714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttactgcgccggatggggttgccgctacg

SEQ ID NO: 53715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttagatcatatttgtagtcctcggcaccg

SEQ ID NO: 53716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttagcggggtctctttgtaagctcctccg

SEQ ID NO: 53717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttaggcgtgggggcacctgcttgctcggg

SEQ ID NO: 53718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttagtaagcgcccacaattgtaaagtggc

SEQ ID NO: 53719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttagttatggaatcatatgcgtgcgagag

SEQ ID NO: 53720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttagttgacaattaacggcactgcgaaac

SEQ ID NO: 53721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttatggtattgcgattcgtagtggttctg

SEQ ID NO: 53722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttatgttttggcacccacacacatgtatg

SEQ ID NO: 53723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttattttcaggtgctagtccccaaggccg

SEQ ID NO: 53724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttcacgcacgcactgtaagtacttgtttt

SEQ ID NO: 53725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttcacggtttgaccacgatataactattt

SEQ ID NO: 53726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttcatcaggtttggttggctcaaacctcg

SEQ ID NO: 53727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttcatcagtcctatatcttctcggggcgt

SEQ ID NO: 53728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttcatccgagtttagaatgctcgagtcgc

SEQ ID NO: 53729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttcattacttcgggatattgactacagcg

SEQ ID NO: 53730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttccaagggtctttaacgctacttgcttt

SEQ ID NO: 53731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttccaatttttcattcgtggtcccgtcga

SEQ ID NO: 53732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttccctaaggtactctacggtatagcgta

SEQ ID NO: 53733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttccgttcgcttcggccaaaagttttggt

SEQ ID NO: 53734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttcggggaactctctcattcatgtccgcc

SEQ ID NO: 53735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttctatgtacagaggtgaaagggaaatta

SEQ ID NO: 53736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttctcgcattacatgttcccaatggttgc

SEQ ID NO: 53737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttctgtgctgtgtgcctatctagtacgtc

SEQ ID NO: 53738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttcttaaggggaagaccccatgcgcgcgt

SEQ ID NO: 53739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgaacgtatgtaggcgttggtatgcgcg

SEQ ID NO: 53740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgaccaggctttggttcggattgcctct

SEQ ID NO: 53741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgacgacgcgactcagtcaattgcgagt

SEQ ID NO: 53742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgagatgcttcctccgtaaatagccgct

SEQ ID NO: 53743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgatccagacttgctatgtatgtgcctc

SEQ ID NO: 53744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgattggagctgaagtacctggtctctt

SEQ ID NO: 53745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgcacgggagccttatattccgacgggt

SEQ ID NO: 53746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgcatacgcgcgccaacctgtgattcac

SEQ ID NO: 53747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgccgctgccgacttgactaccacattg

SEQ ID NO: 53748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgcgcatgcggctggtgagtgcaatgat

SEQ ID NO: 53749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgcgggaggggctcatgtctaggctgta

SEQ ID NO: 53750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgcgggattgtgtctgtttaacctgctg

SEQ ID NO: 53751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgctggatgcgttttttggccggactcc

SEQ ID NO: 53752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgcttgttgtttttacttgttggtgtac

SEQ ID NO: 53753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttggctattagcggcagggggtattgtgt

SEQ ID NO: 53754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgggcggtgattgctattaagtgctctc

SEQ ID NO: 53755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttggggtaccagctgcccaaaagtggagc

SEQ ID NO: 53756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttggtttgtcccagagacggaaggcatcg

SEQ ID NO: 53757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgtagtgccgtgctcttagcctgcgatt

SEQ ID NO: 53758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgtcaaagtaagggcctttctctggttg

SEQ ID NO: 53759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgtcagcagtcagtgaatcgtttgtata

SEQ ID NO: 53760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgtccaaggtgcggcttacgatgtaggc

SEQ ID NO: 53761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgtgtattcgcctccttgatttatgacc

SEQ ID NO: 53762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgtgtgcacgtcatatcacggcgggacc

SEQ ID NO: 53763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgttgctcgtggtcctggtctcgtgtct

SEQ ID NO: 53764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttgttttgaataaacggattgaatattga

SEQ ID NO: 53765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttttaaccattttccaatgcgggagttact

SEQ ID NO: 53766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttttagggttgaaagtccacaaccgtattt

SEQ ID NO: 53767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttttatttccacatcgtcaattcagtgtac

SEQ ID NO: 53768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttttcaagcctcatggcctgttactatgcg

SEQ ID NO: 53769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttttcgttgtgtacgacggttcctactttg

SEQ ID NO: 53770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttttcgtttccgctcctggctcgtcacgct

SEQ ID NO: 53771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttttcttgcgctgtctcgagtgctttggga

SEQ ID NO: 53772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttttagggcgctgtcacgtcgtaccggtg

SEQ ID NO: 53773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttttgctactcccgtgtgacaacccaacc

SEQ ID NO: 53774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttttggtacgaatggcaacgttgcgggta

SEQ ID NO: 53775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtttttgtaggataggcgaagagaaccgcgc

SEQ ID NO: 53776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaaaccgcacctgttaagcctagatacgg

SEQ ID NO: 53777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaactcctggcccggaactgacaggtcta

SEQ ID NO: 53778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaaggcagtttagttttccggttagtcat

SEQ ID NO: 53779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaagtagtaagtataggcccctagaatgg

SEQ ID NO: 53780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaatgcggttatggggcagtggggggtag

SEQ ID NO: 53781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaacaaacggggatacaagggtgcgcaact

SEQ ID NO: 53782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaacactttccttccgcatgcataagaaac

SEQ ID NO: 53783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaccaacgagtgctgcgcttacgctggca

SEQ ID NO: 53784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaccatgtgccgcgcttttccggaaactt

SEQ ID NO: 53785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaccgcaaacgggggtcaccgtggtgtac

SEQ ID NO: 53786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaccgtcagattaacctccgcgatagatc

SEQ ID NO: 53787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaacctgcgctgattctgcccgttatgtat

SEQ ID NO: 53788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaacgagttcgggcgtgagtaaggctgtgt

SEQ ID NO: 53789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaacgcgggtaaccggggcggcataagtcg

SEQ ID NO: 53790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaacgggtgttccctgcctcatccagtctc

SEQ ID NO: 53791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaacgtctgttatacaatggggtgccggtt

SEQ ID NO: 53792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaacttcatgtaccgtgcggtgatcctaca

SEQ ID NO: 53793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaagacattatatgtttcttcggaggtact

SEQ ID NO: 53794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaagacttggtgcatgggtttagctcgcac

SEQ ID NO: 53795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaagcagtgagcaggattgaatttcgtgca

SEQ ID NO: 53796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaggggctccttgcatccccggtggaacg

SEQ ID NO: 53797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaagggtattcggggtttagttccgggccg

SEQ ID NO: 53798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaagggtcgagttctagaagaatagcccag

SEQ ID NO: 53799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaggtctgcggaaatgcgagcacctcggc

SEQ ID NO: 53800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaaggtctggtgcggttgggtcggccgcgt

SEQ ID NO: 53801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaagtcttttgacacgttaggcttgacgta

SEQ ID NO: 53802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaagttgccttgcctccggttatcagcgtt

SEQ ID NO: 53803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaataacggcagtgtgagtatcttgcggcg

SEQ ID NO: 53804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaatatctgtgctgcgttatcgcaatagta

SEQ ID NO: 53805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaatatgggcgctcattgaccagtaattcg

SEQ ID NO: 53806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaatccgagtagcactaagtttccgggcca

SEQ ID NO: 53807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaatctaccgcgatatagatatccgagttc

SEQ ID NO: 53808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaatctcattcgaggttgcgggaagtaagt

SEQ ID NO: 53809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaatgcaatgaattgggccggaacggatgg

SEQ ID NO: 53810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaatggttgattgctggtgtgtaattcccg

SEQ ID NO: 53811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaattacactgcccggctatggtctccgga

SEQ ID NO: 53812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaattgcggctccatgtactctcccgtgtt

SEQ ID NO: 53813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacaacaccggcacggatgagtggcgaaac

SEQ ID NO: 53814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacaacacgaacgcagcggctatatcggtg

SEQ ID NO: 53815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacaatggacggtcttctgactggagactt

SEQ ID NO: 53816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacactcctacctcctgaaggcccgtctaa

SEQ ID NO: 53817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacactttctaaagtagactttaaattaga

SEQ ID NO: 53818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacagattagtgagcggaatagcgtaatcc

SEQ ID NO: 53819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacagattctgtacgcacgcgggtgttctt

SEQ ID NO: 53820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacatgagggccttctgcaacgtgctctaa

SEQ ID NO: 53821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacatgctgccacacgtttgttgcggccgc

SEQ ID NO: 53822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacattagaagttgagagtgcgggactatt

SEQ ID NO: 53823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaccaacgagaacgaggcttatagtgcaag

SEQ ID NO: 53824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaccactgttggcataagtggcaattatgg

SEQ ID NO: 53825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaccagcggaacttgacaagaagctgattc

SEQ ID NO: 53826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaccatgaaaataccgttacgccggttctc

SEQ ID NO: 53827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacccaagatgtgcggtattgattgtctcg

SEQ ID NO: 53828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaccccaggaccaatgtcgtgcctattgta

SEQ ID NO: 53829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaccgttagaggtgtatctattcaaggcac

SEQ ID NO: 53830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacctaacgcggcccgctcttgaacggaac

SEQ ID NO: 53831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacctctgcgattctgagttatgctacgga

SEQ ID NO: 53832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacctggctgccgacatggggggaacctgt

SEQ ID NO: 53833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacctggggtgtgaggtgtacccacaaggg

SEQ ID NO: 53834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacctttccgcgtcggtgtattaaattcgc

SEQ ID NO: 53835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgaacagtggtgtatgcaggactaccac

SEQ ID NO: 53836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgacattgtcagcacctcgatctcgaca

SEQ ID NO: 53837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgacttcaggattagctcgggtcaatgg

SEQ ID NO: 53838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgagaatcctcggttatctgtttgattc

SEQ ID NO: 53839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgatgttgtagggcgtgtcggtcgggtt

SEQ ID NO: 53840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgcatttatgtactgaggatgctgggcg

SEQ ID NO: 53841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgccaccactagcatttccataactgtg

SEQ ID NO: 53842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgccaggaagcatctcgttcatagcgtg

SEQ ID NO: 53843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgcctctcttatgctcattatactactc

SEQ ID NO: 53844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgcgtcaatatttttgcagcacctaacg

SEQ ID NO: 53845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgcttaaccagacgcctggcttgctctc

SEQ ID NO: 53846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacggaactccctcgttattttccaccatc

SEQ ID NO: 53847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacggctgtctgacctcaagacgaattatc

SEQ ID NO: 53848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgggcagcgacacgtcatccgaaggtgt

SEQ ID NO: 53849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgggcgatgacgcgctcccacagcattg

SEQ ID NO: 53850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgggtgttaagcactgcgcttcctccac

SEQ ID NO: 53851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgtaaagctgctgacgtccggcctgcta

SEQ ID NO: 53852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgtcctagctctctttgtaatctcgata

SEQ ID NO: 53853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgtcgacgaggggtgtgtttgactgtgg

SEQ ID NO: 53854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgtgaactctatggccggctacataggg

SEQ ID NO: 53855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgttcagcgttcactgcgattacggcta

SEQ ID NO: 53856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgttgcgagccaatgcgcaatcagcgac

SEQ ID NO: 53857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacgttgggatcgggggcaagattcgtcgc

SEQ ID NO: 53858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaactccgcctctcaacgcccggactcatgg

SEQ ID NO: 53859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaactcctggggggcacctaaataatcacgg

SEQ ID NO: 53860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaactcggtcctgcttgagcggtgttttatc

SEQ ID NO: 53861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaactgattgatcctcgcctcgtcagtcttc

SEQ ID NO: 53862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaactgcatgtttttccaatgtctcgtcgcc

SEQ ID NO: 53863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacttcgtactgcggacgatgattcttgct

SEQ ID NO: 53864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacttctccttgtatgttgcaccgtacgtg

SEQ ID NO: 53865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacttctgaaattggggttgaatattgcgc

SEQ ID NO: 53866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacttctgacagaactatgactgacgtact

SEQ ID NO: 53867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaacttggagggagtgatgtgacctgggctg

SEQ ID NO: 53868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagaaataatgcttctgggattttaaatct

SEQ ID NO: 53869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagaccattaactcatgccccgccggtcgc

SEQ ID NO: 53870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagacggtccttagttatgtcagtcgtatc

SEQ ID NO: 53871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagagactagctggttcagtcggtggtctt

SEQ ID NO: 53872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagagactccttggtcctgcgaactacaag

SEQ ID NO: 53873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagagcgattaggcatctccatcgtggatc

SEQ ID NO: 53874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagaggttgttgttagttccacgcgctctg

SEQ ID NO: 53875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagatagcagcttgcgattccagcgcgacg

SEQ ID NO: 53876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagatggctggtgagtgagcaacgggtccc

SEQ ID NO: 53877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagattcctaagcagtccgttctcttgtgg

SEQ ID NO: 53878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagcaaaaccgaaaaagtagtcggccgggg

SEQ ID NO: 53879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagcagttctgctggccatacttgcctact

SEQ ID NO: 53880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagcatccggaggttgcgccgggtggtttg

SEQ ID NO: 53881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagcccgagacttccgttcccgaactccgt

SEQ ID NO: 53882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagcccggttttcctagcaatcctccttat

SEQ ID NO: 53883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagccgagtaagcgcagcatcaaaggcgcg

SEQ ID NO: 53884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagccgcacgccgtcaacgctgctttgcga

SEQ ID NO: 53885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagcctgccaatcgatcaatattaactgtt

SEQ ID NO: 53886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagcgaatacactggcgcaattgaatatcg

SEQ ID NO: 53887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagctcggacgccactcctacgcaccgtgt

SEQ ID NO: 53888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagctcgtatgcttcagagctctaaacttc

SEQ ID NO: 53889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagcttacgtgattcggctcacggagcctt

SEQ ID NO: 53890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagcttagttctcccagtatgacttgtctt

SEQ ID NO: 53891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagcttctagctatgtggtgtgacgcggtg

SEQ ID NO: 53892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggaacgaattaacgcgtccctgtcctgg

SEQ ID NO: 53893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggacgaggatacgcgggcagtctgtccg

SEQ ID NO: 53894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggacggccaacgccacggtatacccttg

SEQ ID NO: 53895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggagcagcggttggctcgttggcagggg

SEQ ID NO: 53896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggaggatgatgtattcgcaagcggctca

SEQ ID NO: 53897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggcaccgattttatatgtctgcctgtag

SEQ ID NO: 53898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggcactgggaggtacccatgacacgtgc

SEQ ID NO: 53899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggcgcctggtagttcgctgagcagtccg

SEQ ID NO: 53900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggcggtttgcagtgccagaggtgtgtga

SEQ ID NO: 53901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagggcgaatctgatctctttggttggtgt

SEQ ID NO: 53902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagggcgttatgtagggtactggtgatttt

SEQ ID NO: 53903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggtaaagatgggctttgggttgccagga

SEQ ID NO: 53904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggtcacgggtcggatgcatgcgacgcta

SEQ ID NO: 53905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggtgacagctgggagaccactggcgtcg

SEQ ID NO: 53906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggtgtcgccgagtttgtttcctggctgg

SEQ ID NO: 53907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggttaattgtggttcggatgagtaatca

SEQ ID NO: 53908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaaggttggtggtacaccgacgggtctggtc

SEQ ID NO: 53909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtaacttggcgatactttgcgctgcttt

SEQ ID NO: 53910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtaccattatatattggtgcaatctaac

SEQ ID NO: 53911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtatgcagacgcattgaacagtggacgc

SEQ ID NO: 53912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtcaccaaaggaaaagtcttaggcatgc

SEQ ID NO: 53913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtctagatgttgtggcgccgtttcggtg

SEQ ID NO: 53914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtgatagtgagcgtcttttgcgttggct

SEQ ID NO: 53915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtgccaacaaacgcgagcggggtgcacg

SEQ ID NO: 53916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtgcgggagtgtgtcttactgtgggatt

SEQ ID NO: 53917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtggaggggccgtggtcacggaaactgt

SEQ ID NO: 53918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtgggaccgtggacccgctaatcggttt

SEQ ID NO: 53919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtggtcgccaaataaagttgaactcgcg

SEQ ID NO: 53920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtgtgtcacttcgggcctggctgaagag

SEQ ID NO: 53921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagttatagtttgcgggaggataatggctc

SEQ ID NO: 53922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagttgcgacgtttatgctctgtgaactgc

SEQ ID NO: 53923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagttgtgaaagggtaccgcagcgccagca

SEQ ID NO: 53924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagttgttgacttagtgcctgaaatgttag

SEQ ID NO: 53925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaagtttccacatgcttcggcggccattgtt

SEQ ID NO: 53926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaataaaagtgtgcgatgccaagtgggcgtt

SEQ ID NO: 53927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaataagttatcggttagcgacccgctcccc

SEQ ID NO: 53928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatacagtcacaatggtatcgggtggtgac

SEQ ID NO: 53929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaataccacgtgtgtgtggtaaagctatcga

SEQ ID NO: 53930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatacgacatattcttggtgatgcggtttt

SEQ ID NO: 53931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatacgacgttaactttgcggttagatcgg

SEQ ID NO: 53932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatacgcaggcttctcattcgtatttgagg

SEQ ID NO: 53933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatactcggtacgaaacggtacgagtggaa

SEQ ID NO: 53934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatagaatacaggatggccacctccacatg

SEQ ID NO: 53935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatagagacacgggtgtgcccatataatgg

SEQ ID NO: 53936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatagttgtgtgacacgtgtgcgtgtgtgt

SEQ ID NO: 53937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatatgtataactcgattgaatgccgctag

SEQ ID NO: 53938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatcacgacagaacaattacatagccagta

SEQ ID NO: 53939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatcagacaattttgtaatcagagcaagcg

SEQ ID NO: 53940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatcatcgcaaaactgttggttcagctggt

SEQ ID NO: 53941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatcccgagagaatgcccattctcacacgt

SEQ ID NO: 53942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatccgtaccttttcaacgatgatcgtctg

SEQ ID NO: 53943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatcctcccttgaagatcgtgttttggcac

SEQ ID NO: 53944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatcgaccaaaataacgcggcttgagtcct

SEQ ID NO: 53945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatcgagagggcagagattgttttttggtg

SEQ ID NO: 53946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatcgaggtctacccggggtcaacggcccg

SEQ ID NO: 53947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatcgatacctgatgcgtttcctccacaac

SEQ ID NO: 53948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatcggaggactttgataagacttcggcac

SEQ ID NO: 53949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatctacacactgttacatgtaacgcgtca

SEQ ID NO: 53950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatctcaagctcttatttgtgaaatcatcg

SEQ ID NO: 53951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatctcgcaggcgccagttatgtggatgta

SEQ ID NO: 53952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatctggcagaatagactgatacctcagtg

SEQ ID NO: 53953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatgacatagttgaccctggcctggcgaga

SEQ ID NO: 53954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatgagcatctttcgggagatcttccaacg

SEQ ID NO: 53955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatgattcaagtaccattggatataggacg

SEQ ID NO: 53956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatgcactgacctgacttaccgcgttcatc

SEQ ID NO: 53957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatgccgtatgggctgtacatgacgggcgt

SEQ ID NO: 53958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatgctagtcgaaggcatggaagtgttggg

SEQ ID NO: 53959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatggcaactgctgatgacagcctctgtgg

SEQ ID NO: 53960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatggtcccaccggcgtctaacctctcaca

SEQ ID NO: 53961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatgtatagctttgaacgtgagtataagtt

SEQ ID NO: 53962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatgtctctatagatgccagagtaagtttc

SEQ ID NO: 53963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaatgtgcctgaactcgttgagcactttcgc

SEQ ID NO: 53964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaattacatggcgaagagttaatcgtggtca

SEQ ID NO: 53965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaattacgtgattattatcagctgcttgttg

SEQ ID NO: 53966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaattcactgctttatagagtcggaacccgc

SEQ ID NO: 53967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaattcgcgccgggttcaaatctcgcccata

SEQ ID NO: 53968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaattcgcgtaggcggacccaatggtattgg

SEQ ID NO: 53969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaattcggagagtgttagacttggtgccagt

SEQ ID NO: 53970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaattggcagaatggtatcgagactcaacct

SEQ ID NO: 53971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaaaaactacctcagctcatccaaggact

SEQ ID NO: 53972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaaaacttcatcgcttgatgtgaccagtt

SEQ ID NO: 53973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaaacatcggggaggaagcgcaagaggcg

SEQ ID NO: 53974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaaaccgggcgctcttttattggtttgtt

SEQ ID NO: 53975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaaagtggtgatgggtcagcctgaagttt

SEQ ID NO: 53976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaaatccaagatgtccctgaacattatag

SEQ ID NO: 53977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaacacggcgacggagtaggaggaatgtc

SEQ ID NO: 53978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaacccacctccttgtaattgaggcccca

SEQ ID NO: 53979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaacggcagcatgctgggcgtttcttggg

SEQ ID NO: 53980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaacgtataagggatatagccttacccgg

SEQ ID NO: 53981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaacgtgcctcatggctctccgcgcgacg

SEQ ID NO: 53982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaagactgttaggttttttgaataatttc

SEQ ID NO: 53983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaagcccgaagttaacgattggtttcgcg

SEQ ID NO: 53984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaagcgagactacataatcgccaaggtca

SEQ ID NO: 53985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaaggactaaccaaacaggcgccgaactc

SEQ ID NO: 53986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaagggggcttcgctgcaacggaatgcgg

SEQ ID NO: 53987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaagtgcgcgagattggtatgtggttcaa

SEQ ID NO: 53988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaatactgggaccgccaatcaagtgtcca

SEQ ID NO: 53989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaatgtggaattctggtggcgtatcgtgt

SEQ ID NO: 53990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaattcacacgatcaaataactccttcgc

SEQ ID NO: 53991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaattgggcaggcacttcgcgcgtatccc

SEQ ID NO: 53992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacacaggcatcttgctgcacgcgccgcttg

SEQ ID NO: 53993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacacatccggaggggagccatagcttgcgg

SEQ ID NO: 53994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacacatctgatggcaactcgacacggaaca

SEQ ID NO: 53995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaccacgaagccagtcgtgcgcgttcatg

SEQ ID NO: 53996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaccgcacctcaccatgcgtacgtgatca

SEQ ID NO: 53997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaccgcagttgttcatcgtgtttggtgcc

SEQ ID NO: 53998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacacgctgtgagagctaacgatcgcgggat

SEQ ID NO: 53999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacacgggagtcttgggtgttgtaggttcga

SEQ ID NO: 54000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacacgtagtaaaccggcctctctctgggtg

SEQ ID NO: 54001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacactagcgctagtattttggtttcagtcc

SEQ ID NO: 54002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacactaggggtcgtgggtagcgttacccaa

SEQ ID NO: 54003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacactcttgacacgaaagggtcactgcctc

SEQ ID NO: 54004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacacttctgtagaggatatctggcactttg

SEQ ID NO: 54005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagaagccgatcacgacgattgcgaacac

SEQ ID NO: 54006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagagctgactctactaaaggttggtggc

SEQ ID NO: 54007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagccgaaaggagacgttcgaactcgcgc

SEQ ID NO: 54008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagcgacagggacgtatacgatgctcgtg

SEQ ID NO: 54009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagcggattggcgagtagccctcgacgct

SEQ ID NO: 54010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagcggcacatgtatggcagcacgcatcc

SEQ ID NO: 54011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagctcgggcgacgcaatccagctgccgt

SEQ ID NO: 54012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagctggttactaagtggtcaagggtgta

SEQ ID NO: 54013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaggaagccgtatcatccctagcttcttg

SEQ ID NO: 54014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaggcagctgttattagaagagaggtgca

SEQ ID NO: 54015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaggcatcgatgcgagctcaatagcgtgg

SEQ ID NO: 54016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagggggttatggcgcggtgccgaaggct

SEQ ID NO: 54017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacaggtggttgttaatcggaggagaatgcg

SEQ ID NO: 54018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagtaacgatgatgcctcgctcaattgtc

SEQ ID NO: 54019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagtatacgtcaagtacgagtaaggtgcg

SEQ ID NO: 54020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagtattaagtaggcttttttgtgggtta

SEQ ID NO: 54021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacagtcgttgtacccgggggctttttgttg

SEQ ID NO: 54022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacatcacaacggtcaattacgtatctacgc

SEQ ID NO: 54023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacatccggccacgttcctcacgcgcgcgat

SEQ ID NO: 54024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacatccgggcattttggtatacatcttggc

SEQ ID NO: 54025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacatccttgacggtatcatattctccacgt

SEQ ID NO: 54026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacatcggggtggctacggtcctcctgtcgc

SEQ ID NO: 54027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacatggcgtgaccattaacaacacgtacgc

SEQ ID NO: 54028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacatgtaggttctgtcgcttgtagatgtcg

SEQ ID NO: 54029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccaaacatttgggggcgtaagtggcgcct

SEQ ID NO: 54030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccacaatttgtaactttagaaacgggagt

SEQ ID NO: 54031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccacatgccgaatgataggatccagagcg

SEQ ID NO: 54032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccacccgggcccatcaccagaagctgagt

SEQ ID NO: 54033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccacctgatgaattgttttgcacgccgtc

SEQ ID NO: 54034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccacgtatctacgctgttgcaccgaactg

SEQ ID NO: 54035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccacgtgttcattaccgatgtacaatcga

SEQ ID NO: 54036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccacgttaaacgctatgccaagaatggag

SEQ ID NO: 54037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccagcacatcccagcaagtttgagcccgg

SEQ ID NO: 54038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccaggttggctatgtctgttggtcaggct

SEQ ID NO: 54039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccagtcacaaaattaaaagtaggatcgcg

SEQ ID NO: 54040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccatcgtagactcaactcgtcagcgcgga

SEQ ID NO: 54041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccatgaccggctttcacatgttattggag

SEQ ID NO: 54042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacccaaacgtcatgtgctccgaggtccaac

SEQ ID NO: 54043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacccaccggcagggatcatcttcgcgcatc

SEQ ID NO: 54044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacccagcatcggtcacgcccagacatcgac

SEQ ID NO: 54045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccccagcggtcagtttttcatacggctct

SEQ ID NO: 54046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacccctgacatgatcccggcgcgtcggatc

SEQ ID NO: 54047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacccgaaacgtcccgtgcggaagtgctggt

SEQ ID NO: 54048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacccgcatcgatgtggtgggagctagccat

SEQ ID NO: 54049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccctatcctcgtgttttagggcattatag

SEQ ID NO: 54050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgaatcctgcttgtgatgtggaccgcca

SEQ ID NO: 54051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgatatgagcacgcatactcgatcgagg

SEQ ID NO: 54052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgatcgggaaggcaatcgaaagattcca

SEQ ID NO: 54053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgcacactgcgtcttttcatgtagcctg

SEQ ID NO: 54054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgcactggtcgataggcatcatgggttt

SEQ ID NO: 54055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgcactgtgaatcgagttgggagctttg

SEQ ID NO: 54056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgcatgcattccacgacaggccgtggtg

SEQ ID NO: 54057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgcattacttctggcgcataatcatcct

SEQ ID NO: 54058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgctatttgtaacgtgtcagggggatgg

SEQ ID NO: 54059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgcttaatcttatctatcttgaagcgtg

SEQ ID NO: 54060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccggacctgctctcattgtccagtgccat

SEQ ID NO: 54061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccggaggttggcaccagagacacgtcacg

SEQ ID NO: 54062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccggcacattggtatgtcggcggtatatc

SEQ ID NO: 54063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccggcagcgagcccatttttgccagggtg

SEQ ID NO: 54064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgggcagttaggtaagcagcgtcattat

SEQ ID NO: 54065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgggggcccgcgctgttttacttttgga

SEQ ID NO: 54066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccggggggtcggtcaaaggtgtggacggc

SEQ ID NO: 54067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccggttctcttcgcagagtgcggtccgtt

SEQ ID NO: 54068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccgtggcttagctcccgaggatgggcctc

SEQ ID NO: 54069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacctaaggtcgtgccgatttgttatacaag

SEQ ID NO: 54070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacctatctaagagttgggtggtgagattat

SEQ ID NO: 54071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacctcggacattcaattattgtattctctt

SEQ ID NO: 54072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacctcggtcgtctcaggaggagcggcatca

SEQ ID NO: 54073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacctcgtacgtgcattacccaatggccgcc

SEQ ID NO: 54074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacctcgttgcgctacttagggtggtgagtg

SEQ ID NO: 54075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacctcgttttagattctgcacttccatcac

SEQ ID NO: 54076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacctggtttagagagtattgtgagcgagga

SEQ ID NO: 54077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccttcatgacgtttgcagcttccttaccg

SEQ ID NO: 54078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccttctggaaatattgatccgtctggggt

SEQ ID NO: 54079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccttgatacaccgattttgattaagcccg

SEQ ID NO: 54080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaccttgattgcaaccgccatcctatcgatc

SEQ ID NO: 54081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgaaaggggattgtgaaagacggggttcc

SEQ ID NO: 54082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgaaattttcggaacccgccctacgtcct

SEQ ID NO: 54083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgaactgttatttgcctgcactatatatc

SEQ ID NO: 54084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgaccacgatccgctatgagaaaaatcga

SEQ ID NO: 54085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgacgaacgcgacggcccagcaggcgagt

SEQ ID NO: 54086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgacgctgatgatgggatgctacctccgg

SEQ ID NO: 54087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgacggagcagtaaaatcagaataggtct

SEQ ID NO: 54088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgacgtaaccgcagggctcgtcgccggca

SEQ ID NO: 54089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgactcccgagcggacgggtctggtggtt

SEQ ID NO: 54090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgactcggaattgacaaattctcgtatgt

SEQ ID NO: 54091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgagaaagacatcaaggagctgggatagc

SEQ ID NO: 54092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgaggcgaatagtgcccgtgcagcgcgag

SEQ ID NO: 54093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgaggcgagatgatcggttacccaaatga

SEQ ID NO: 54094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgaggcgatacacgctgtcggtgctctct

SEQ ID NO: 54095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgaggcgattagtttgtggttattgatgc

SEQ ID NO: 54096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgaggcgttgaggcgattgataacgagct

SEQ ID NO: 54097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgagggacggccggctgctgattgatcgt

SEQ ID NO: 54098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgagggtattttatccagttactgttggt

SEQ ID NO: 54099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgatatgtgcgtacgattggaccaggact

SEQ ID NO: 54100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgatgagtggcttacatggggacgacggt

SEQ ID NO: 54101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgatgtatgtcacgcgctgaatcctcgag

SEQ ID NO: 54102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcacatcgttttgatcggcgcctccctg

SEQ ID NO: 54103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcagccgcttatttccagtgtgtagtct

SEQ ID NO: 54104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcagccgtgaagggacaagcgtgtggac

SEQ ID NO: 54105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcagggattctccacggtgcacgatgtt

SEQ ID NO: 54106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcatcccttgagacgtcgatcgctactg

SEQ ID NO: 54107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgccacgagattattttatcacgatttcc

SEQ ID NO: 54108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcccaagtacgttcgagtccggacgggg

SEQ ID NO: 54109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgccgaataactatgcatcttgcagctgc

SEQ ID NO: 54110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgccgaatgtcctcgattctcgtccggat

SEQ ID NO: 54111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgccgagaaccgtgacgaaccgagggacg

SEQ ID NO: 54112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgccgtaagatttcacgcgctatcgttta

SEQ ID NO: 54113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcctaccgtttccgcattgggttcagga

SEQ ID NO: 54114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcctttcaccagtatcgtcttgtacctt

SEQ ID NO: 54115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcgaagaggggctcgtcagggaggtttg

SEQ ID NO: 54116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcgagcggaatggagcgcggttcacatc

SEQ ID NO: 54117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcgcgaggcttattggcaaggacaccgt

SEQ ID NO: 54118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcgctaatccgggttgaaggtgtctctc

SEQ ID NO: 54119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcgtcaggggccataggttaatcccagc

SEQ ID NO: 54120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcgtgggacctccacaatctgcggtggt

SEQ ID NO: 54121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcgttggcctcaattcatggtatgccat

SEQ ID NO: 54122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgctactgacggtggataggtaatgatgt

SEQ ID NO: 54123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgctactgatttaacccagccatgcggga

SEQ ID NO: 54124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgctcatggctggatcgctttttatgccc

SEQ ID NO: 54125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgctgcgtcacctggtattcggtcttgca

SEQ ID NO: 54126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcttagggtccacgacttacgtatgtgg

SEQ ID NO: 54127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgcttcgattacggttttgttcgtatcct

SEQ ID NO: 54128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgctttcgcatttacgagagttgaacaga

SEQ ID NO: 54129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggaagttgcgacaacttttagtcgcggc

SEQ ID NO: 54130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggaccactgtcaatgtgttgtggagtat

SEQ ID NO: 54131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggaccattctccatgctggcacaccgct

SEQ ID NO: 54132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggagcggtgcttgctaggattgccagtc

SEQ ID NO: 54133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggatgcagcaggtgggggaggaatactg

SEQ ID NO: 54134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggcagttcggtcagtgtaacccggttcg

SEQ ID NO: 54135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggcatgttttcgagttaaaatatgctgg

SEQ ID NO: 54136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggcctactgcggaagacagctcgtggac

SEQ ID NO: 54137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggcgctacagggaaacgacgtgggtctg

SEQ ID NO: 54138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggcgctttcaggtggtgtgttcgacatt

SEQ ID NO: 54139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggcggcagggaggaagcgcggtatcaca

SEQ ID NO: 54140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggctagaaactccatgtatactggtatt

SEQ ID NO: 54141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgggcggtttacggatcgtgctagaaatc

SEQ ID NO: 54142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgggctcacggtggctgcgatactggcac

SEQ ID NO: 54143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggggaaagggcagatgtcgggcggcaat

SEQ ID NO: 54144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggggcgcgaatccacatgcgcgtgaagg

SEQ ID NO: 54145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgggggcagcaccaaagccattgttagcg

SEQ ID NO: 54146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggggtagcagagaaggatcagggccacg

SEQ ID NO: 54147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgggtaaggtagtcacctctgccagtttc

SEQ ID NO: 54148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgggtgaatctttgccaagggcagagcaa

SEQ ID NO: 54149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgggtgtgcgccagagtgtaaccaaacga

SEQ ID NO: 54150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggtaatcatcgggtaatggtaggatttc

SEQ ID NO: 54151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggtcgcgttgttaagttataccgcgggt

SEQ ID NO: 54152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggtgggggatgtgtcttgttacgtgcgt

SEQ ID NO: 54153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggttaactcctcgttttggaagggtgta

SEQ ID NO: 54154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacggttgttccttgactcccttcgtactgg

SEQ ID NO: 54155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgtccggccacacctgggacaagactgtc

SEQ ID NO: 54156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgtcgctgctaagaaaactgcgtcttggg

SEQ ID NO: 54157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgtgcaccgaagagttgcagtgcgagatg

SEQ ID NO: 54158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgtgccggggatgagtctcgccgggagca

SEQ ID NO: 54159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgtgcgacgtgtaacggaaggcttcgtac

SEQ ID NO: 54160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgtggggatgcgcattggctcgaacggtc

SEQ ID NO: 54161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgtgtggattcacctagctatcgagttga

SEQ ID NO: 54162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgttctgtttttatacagttttatgagcg

SEQ ID NO: 54163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgtttcgtgcgatcttcgggctacaggct

SEQ ID NO: 54164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacgttttatggtatgtttctcagtctggtt

SEQ ID NO: 54165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactaaattaagtctcatgtgtgaccttttg

SEQ ID NO: 54166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactaactggtctcgctggtgacgtaatctg

SEQ ID NO: 54167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactaagggcctttttgtctgagaacagcaa

SEQ ID NO: 54168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactagacgcgtatccgtcggagatcctgta

SEQ ID NO: 54169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactagagaacgcccagggctcctcttcacg

SEQ ID NO: 54170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactagaggcattatcgacggcggctgggtg

SEQ ID NO: 54171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactagtccagtcatgtgatacttacgtcgt

SEQ ID NO: 54172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactagtgcctgggctcgctctcaaattagc

SEQ ID NO: 54173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactatctcgttcaccaactcgttcctctct

SEQ ID NO: 54174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactcacctgcctttctgctcgtacatgtgc

SEQ ID NO: 54175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactcagcgaggcaatttgaaccggaacctc

SEQ ID NO: 54176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactcatagtgacggtcaattttcccctgca

SEQ ID NO: 54177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactccagcatggggtcgctctcgggctgtg

SEQ ID NO: 54178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactcgaacgtcacctttgcgggtcttgcgg

SEQ ID NO: 54179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactcgccacggctgcatcgagttggttcct

SEQ ID NO: 54180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactcggcgtgcattagagcacaacgaccgc

SEQ ID NO: 54181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactcgtaagttcgatttgattcagctgcct

SEQ ID NO: 54182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactcgttgttgtcttacggacgcaaatgag

SEQ ID NO: 54183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactctacgagcgggactagcattggtgcgc

SEQ ID NO: 54184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactctacggaatttggtcatgtctcgccga

SEQ ID NO: 54185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactctagtttcagtctcccgcgaattgtga

SEQ ID NO: 54186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactctgactcgggaggttgaggggggcgta

SEQ ID NO: 54187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactctgggtgtagagaagattttttggtac

SEQ ID NO: 54188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactcttctcagctgcatttctcgtggtccc

SEQ ID NO: 54189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactcttggggttaaggctctctaacgtggg

SEQ ID NO: 54190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgactactgggctgtggtcttctttgcc

SEQ ID NO: 54191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgagggacaggggctaggtagggatggt

SEQ ID NO: 54192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgcaagcgtgctatccaaatactatacc

SEQ ID NO: 54193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgcacaccccacgattatagcttacggc

SEQ ID NO: 54194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgcaggccacgcgggatcgcgtctgtca

SEQ ID NO: 54195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgcgaataattgtggtcagattcagcgg

SEQ ID NO: 54196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgcgatcaattacctttcgtactttcgg

SEQ ID NO: 54197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgcgccgtccggtacgagagtattcgtg

SEQ ID NO: 54198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactggaattatgttttttggggggacacgc

SEQ ID NO: 54199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactggccactatgataaccatcaacctggg

SEQ ID NO: 54200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgtcgcggaactggttcctgtctccgta

SEQ ID NO: 54201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgtgcggcttttacgggtcccatggtgc

SEQ ID NO: 54202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgtgcgtagtttgctcgggcgtatatcg

SEQ ID NO: 54203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgttccttgatttgttaattcacgctaa

SEQ ID NO: 54204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactgttgcgcattcaatcaacaacgacggg

SEQ ID NO: 54205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttaatcgcgtcgctcagtggatccggct

SEQ ID NO: 54206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttatagttcagcggacgtcccgtgaacc

SEQ ID NO: 54207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttcccagggtacttagcctactctaaca

SEQ ID NO: 54208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttccgcagtgaggcggatagattttggg

SEQ ID NO: 54209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttccgctacatacacagttagaaagttg

SEQ ID NO: 54210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttcgagatttgccttttcgggagatatt

SEQ ID NO: 54211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttcggtccgcagttgtgtagagttcagg

SEQ ID NO: 54212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttgcacccgcatacgttgttatgacatt

SEQ ID NO: 54213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttgccgagtggatatgtttccagatgtc

SEQ ID NO: 54214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttgggtaacggaacgagagagcttcgtg

SEQ ID NO: 54215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttgtccgcgttgtgagaggtgaggccca

SEQ ID NO: 54216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactttgcctcggaatgttcggcaagcggca

SEQ ID NO: 54217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtactttgtataccgtagcggcttcaagttgt

SEQ ID NO: 54218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtacttttctatccgggatttgttttagcctc

SEQ ID NO: 54219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaaactttaacacgctaatcgaagggtgg

SEQ ID NO: 54220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaacggaagtggggtggttataaagaaat

SEQ ID NO: 54221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaacgggtaaaccgagtgtcgtaggcacg

SEQ ID NO: 54222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaacggtataagaattaaggtttcgttgc

SEQ ID NO: 54223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaagaactgacgcccaaagacgggtggtg

SEQ ID NO: 54224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaagattaagtcggttcaccccgtgtctt

SEQ ID NO: 54225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaagcatgtagggtatagggcgctagggc

SEQ ID NO: 54226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaagcgcaccatcacttttggagttcggt

SEQ ID NO: 54227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaatgtgctgggttgcatataactcgcgt

SEQ ID NO: 54228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaattgcataaggcgggatcccttgttat

SEQ ID NO: 54229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacagtggaaccgcgatgttgtgaggagg

SEQ ID NO: 54230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacatagggtatcgcgttattccggggct

SEQ ID NO: 54231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacatcaactcccgggtgggacatcatac

SEQ ID NO: 54232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacatcacaggacgcgcgctccgtggtcg

SEQ ID NO: 54233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaccattgggagtgtcgaggctagcaata

SEQ ID NO: 54234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacccagcgacttacagtctccaatctgc

SEQ ID NO: 54235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaccgcatgtgtacgtcggctcttgctct

SEQ ID NO: 54236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaccggcatatagagtgatcacgggccgc

SEQ ID NO: 54237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagaccgtgggcatcaggattaggagcacta

SEQ ID NO: 54238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacgatgcaggtttccctttgctgcgtag

SEQ ID NO: 54239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacgattgtcgccttaccgttttacgcgg

SEQ ID NO: 54240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacgcaagcaccttaaggccctccccctc

SEQ ID NO: 54241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacgcccggaatgaagatgagctcggtgg

SEQ ID NO: 54242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacgcgattgaccagtagcgtcacgcttc

SEQ ID NO: 54243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacgggaggtaaagtgcgcacccatcatc

SEQ ID NO: 54244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacgggatgagtaaacacttcctgccggc

SEQ ID NO: 54245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacggggagatgtgcgcataatgcttcat

SEQ ID NO: 54246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacggttggaagaaaggcggacgatttga

SEQ ID NO: 54247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagacgtccacgttactgtaatcttgtggtc

SEQ ID NO: 54248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagactccagacgcgtgcagaggcaatgatg

SEQ ID NO: 54249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagactccggaaactctctgcgtcagtcggt

SEQ ID NO: 54250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagactcgcgatttgaacgctttgcactgcg

SEQ ID NO: 54251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagactgattgttttattggacttacaattc

SEQ ID NO: 54252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagactgtgttgtgtgtcatttcttgagcgg

SEQ ID NO: 54253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagagatacagtcggcgaataaatttttgcc

SEQ ID NO: 54254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagagcaaagcacttctcgggacgctaggct

SEQ ID NO: 54255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagagcacactagaacagatgcattggccgg

SEQ ID NO: 54256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagagcacgctggcatcacaggttgacccgc

SEQ ID NO: 54257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagagcataacgcagtgttaaggaacggtgc

SEQ ID NO: 54258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagagcccccatcgaccttcaacgtcttcgc

SEQ ID NO: 54259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagagcgcgcgatggccgaacggttcttcat

SEQ ID NO: 54260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagagtgatggtggtcagttaactgtgccgt

SEQ ID NO: 54261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagagtggcagcggcacgaattgcgggaatc

SEQ ID NO: 54262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagatcgtccgcttaaccattgttctcttca

SEQ ID NO: 54263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagatctcgttcgatgggtgacttcccctct

SEQ ID NO: 54264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagatctgcttttacactaaaatggtttcgg

SEQ ID NO: 54265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagatgggtcaagtcgtatcggagttgggta

SEQ ID NO: 54266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagattaagggagcgactggacgtagatacg

SEQ ID NO: 54267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagattcgttcccctcgtgttggtgaccgct

SEQ ID NO: 54268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagatttttgtgcggacggatcatctgtgta

SEQ ID NO: 54269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcaatcggtgaggtggcagcctttgagac

SEQ ID NO: 54270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcaattgccactggtcttcttgcgttttc

SEQ ID NO: 54271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcacacaaaataggccgatacacacagtc

SEQ ID NO: 54272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcaccagcgaggccgcagggtagcgcact

SEQ ID NO: 54273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcaccgggtatctccctggcaccttccgc

SEQ ID NO: 54274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcacgcctaggcacgtttggtgacggctc

SEQ ID NO: 54275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcactggggaagtactcattcggcggggt

SEQ ID NO: 54276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcagaagatttgttttgataagtgacggc

SEQ ID NO: 54277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcagacttgcagcttgctcatcgggtttt

SEQ ID NO: 54278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcagcatttccaagtattcactctccctc

SEQ ID NO: 54279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcagcgaaaccgtcgtccaccgccgcctc

SEQ ID NO: 54280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcagcggtgttttgtgtccgagctagggc

SEQ ID NO: 54281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcaggagcccatgccaggatgggtcgcaa

SEQ ID NO: 54282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcagtcacttgccatattaaactcccggt

SEQ ID NO: 54283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcataccgcgtgggttctactgggagggg

SEQ ID NO: 54284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcatagtccttactagtcacgcctcctcc

SEQ ID NO: 54285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcatcctcaaggctgtgtagaatccgggt

SEQ ID NO: 54286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcatgcgaagttcaacgggtgtgttctcg

SEQ ID NO: 54287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcatgtgcgcggtggccgattggggcagg

SEQ ID NO: 54288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagccaacgcgttgctttgtggagtctaagt

SEQ ID NO: 54289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagccacagtattccgactcgcgagggtccg

SEQ ID NO: 54290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagccagacccttggtcatcgagcaggctgg

SEQ ID NO: 54291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagccaggcgggcgggaaagcggacgtgagg

SEQ ID NO: 54292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagccatctagagattggggcgtgctcgtgt

SEQ ID NO: 54293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcccgagtatccagattgcaagcttgcgg

SEQ ID NO: 54294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagccctgggtcgtagcgcataggcaaggag

SEQ ID NO: 54295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcccttcacgcagggattattggttggta

SEQ ID NO: 54296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagccgcgtacaaaccgtgcggggtgtagag

SEQ ID NO: 54297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagccgcgtcttattcatctcgctggttgtg

SEQ ID NO: 54298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagccggcagaggtaatggtacaacttgcaa

SEQ ID NO: 54299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcctattaggggtctgttgttcggcttcg

SEQ ID NO: 54300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcctcgaccgcagcgtgtatgttttcctg

SEQ ID NO: 54301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcctgccatatcagagaggctggttgcgt

SEQ ID NO: 54302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcctggtgttttccttcgctactagtttg

SEQ ID NO: 54303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgaagcgggtgcagccaaagctatcgtc

SEQ ID NO: 54304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgaattggacgttcgttctagcattccc

SEQ ID NO: 54305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgagtaagagtactcgaggcaggagctg

SEQ ID NO: 54306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgatcggacggcaagaacataataacgc

SEQ ID NO: 54307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgatgacagcgtcgttacaaagggcatt

SEQ ID NO: 54308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgccggtgggcttcaaggcagagagtgt

SEQ ID NO: 54309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgccgtgagataatagcgtagcagaccg

SEQ ID NO: 54310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgcgtggtactggagtacatcggcatct

SEQ ID NO: 54311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcggctgatttaaactcgtccgtgcagtc

SEQ ID NO: 54312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgggaggctcgctcggttcgtaccagcg

SEQ ID NO: 54313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgggatcgctccttatttgcccacgtcc

SEQ ID NO: 54314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgggcctagggatacccgatgttcataa

SEQ ID NO: 54315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgggctcggtcaatactcgaaaggtgca

SEQ ID NO: 54316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcggggagaattaaacaccgagcggtgtc

SEQ ID NO: 54317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcggtactggaattgtgtgttcgcgtggg

SEQ ID NO: 54318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcggtcgaagtcgacttcgcgcattctca

SEQ ID NO: 54319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcggttaagagcaatggacggttcagccc

SEQ ID NO: 54320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgtagccgactttatttcacgcatgggg

SEQ ID NO: 54321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgtagcgcagaacggggcgggcgcacat

SEQ ID NO: 54322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgtaggcttgcaagatcatttcagagac

SEQ ID NO: 54323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgtaggtgagcaggggctgacagacgtg

SEQ ID NO: 54324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgtgattcctagcgtagtgcttctacgg

SEQ ID NO: 54325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgtgccgccgcggaatgcccaggtgtgg

SEQ ID NO: 54326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgtggaggctctctattggataacgact

SEQ ID NO: 54327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgtgtaggagtgttcagtcgacacaaag

SEQ ID NO: 54328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgtgtcgagactttggggcgtaaagggc

SEQ ID NO: 54329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcgtgtgtctaactctcgggttggggcgt

SEQ ID NO: 54330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctaaggttttggtcaggcctgggacatg

SEQ ID NO: 54331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctagaaaaggtgcgctgtaagtccacta

SEQ ID NO: 54332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctaggaggcgataggggacacgggaccg

SEQ ID NO: 54333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctcagcgtgcgacgctcacgtgtaggtt

SEQ ID NO: 54334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctcccacatgctgcacttaacagcttgc

SEQ ID NO: 54335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctcctccgctcgatcttaagccggcctc

SEQ ID NO: 54336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctctacagacaacgtgtacgtctgtgca

SEQ ID NO: 54337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctctcttagacaacaacctcgagcatcg

SEQ ID NO: 54338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctctgaaggactgtatcttttcccagac

SEQ ID NO: 54339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctgcggtcgagcctcgtgactctcgatg

SEQ ID NO: 54340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctggcgagggagcgtattattgttacgc

SEQ ID NO: 54341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctgtgtcgtgcattgtgtatcactgaca

SEQ ID NO: 54342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagctgtttcactggtttgcttgatcactgt

SEQ ID NO: 54343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcttaccgttggggtacctcacgtctcga

SEQ ID NO: 54344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcttacggcgttactacgctttacggggc

SEQ ID NO: 54345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcttgcaacatcttttggcgttggtgatt

SEQ ID NO: 54346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagcttttcagtgtgcgcgatgcccactggt

SEQ ID NO: 54347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggaaattaaagtcttaacgtctctcagtg

SEQ ID NO: 54348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggaacagtgaacctgccaattgtggccac

SEQ ID NO: 54349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggaactaaagagtagaggttgcggtgtca

SEQ ID NO: 54350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggaagcgagttattacctaatcacgctca

SEQ ID NO: 54351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggaagcgtatggtcgggtctgaaacgtgg

SEQ ID NO: 54352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggaccgcaaggaggcctatatgcttcaca

SEQ ID NO: 54353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggagaggagtaggagtacagcgtcgttga

SEQ ID NO: 54354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggagcctgcagggtgtggtatgcgcgttc

SEQ ID NO: 54355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggataaacggtcctgggattgtctttctg

SEQ ID NO: 54356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggatgatacagccgactgatcgtactctc

SEQ ID NO: 54357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggatgcaaacaggcgacggaaacacctat

SEQ ID NO: 54358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggattacttcccagctgcaacgttgccgt

SEQ ID NO: 54359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcaacacaatacagagtgaccagcgggt

SEQ ID NO: 54360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcaaggactcacccgggcattcctgggg

SEQ ID NO: 54361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcatgccccgcgaatcggaactgccgtg

SEQ ID NO: 54362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggccagtcgaacagttcggctttggggtc

SEQ ID NO: 54363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcccattgcaattgttgagctggctgaa

SEQ ID NO: 54364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcccctcccacttaggcagtctttggtc

SEQ ID NO: 54365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggccgacgggggactagttctcggccggt

SEQ ID NO: 54366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggccggcaagaatccttttaagtctgtgc

SEQ ID NO: 54367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggccgggcatggcgggcgacaggatcgta

SEQ ID NO: 54368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggccggttaccaatgcgacccgtcacgta

SEQ ID NO: 54369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcctttcccatccgcccgttccttatgg

SEQ ID NO: 54370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcgacaatcttcgagcgatgtgatgtac

SEQ ID NO: 54371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcgagagaagaggagcggtccagccttt

SEQ ID NO: 54372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcggcacaaaaggggccacggctcgtta

SEQ ID NO: 54373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcggcggtcctggtcccatttctgccga

SEQ ID NO: 54374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcgggatgtgacagggtaaggattgctc

SEQ ID NO: 54375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcgtgaataatgcggattatgctccggg

SEQ ID NO: 54376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcgtggtttatcggggccatcgggcgtg

SEQ ID NO: 54377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggcgttgtggaccgtaagttttttcgata

SEQ ID NO: 54378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggctcagagcactcccacatatggatctt

SEQ ID NO: 54379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggctcccgttaaggctctactgtcccgca

SEQ ID NO: 54380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggaacgggtttgcttctcggtggttcca

SEQ ID NO: 54381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggagcaatggcaaggtcgatgcgttggc

SEQ ID NO: 54382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggatgccattgacggaagctggtggttt

SEQ ID NO: 54383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggcaacgctgacagtgcgtctacggacg

SEQ ID NO: 54384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggcatgtcgacttaacattgtgcgcggg

SEQ ID NO: 54385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggccgatcgctcctcagatactgtagtt

SEQ ID NO: 54386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggcgatatcaatgggcagggcgggtttg

SEQ ID NO: 54387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggcggctaactccttctaggacttctaa

SEQ ID NO: 54388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggcgtgctatgaatatgtttagaatgtt

SEQ ID NO: 54389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggcttctggctccctcggagaatggttt

SEQ ID NO: 54390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggggactcaaaaggatgattgcattgagt

SEQ ID NO: 54391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggggactggaggggcgcaaggaggcctaa

SEQ ID NO: 54392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggggtaaagatcggaatcggagtacggg

SEQ ID NO: 54393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggggtggctagtcttcgttcagggtttg

SEQ ID NO: 54394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggggtacattaatcaatgctcggctgtcc

SEQ ID NO: 54395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggggtcgtccggggtggctacccttactg

SEQ ID NO: 54396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggggtttcggggtacgaggtcttccacga

SEQ ID NO: 54397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggtgcaaagacagtgcggtgatacactg

SEQ ID NO: 54398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagggtgcgcgcctccgtacagtgcggccaa

SEQ ID NO: 54399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtacgcttgtggctttcggcttgggccc

SEQ ID NO: 54400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtacggtatctctgggttacgccggcgg

SEQ ID NO: 54401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtacgtgactgattacggatcgggtatg

SEQ ID NO: 54402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtcaacttacgctaggctgttgcatctt

SEQ ID NO: 54403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtccgacgcgtttgcgccgtctagtaag

SEQ ID NO: 54404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtccgtgagatatgcgcccggcgcgttt

SEQ ID NO: 54405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtctcttcatactactgtctggtgatgg

SEQ ID NO: 54406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtgacgtgaccctgttgatgctacaggg

SEQ ID NO: 54407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtgactcggcgtgcactgttttttcagt

SEQ ID NO: 54408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtgcactgcgcgaaacacctcttggcat

SEQ ID NO: 54409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtgggacatgaaccggggtttttccgct

SEQ ID NO: 54410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtgtgcaagggaccaacacgggacgctg

SEQ ID NO: 54411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtaggtttggctgtctggggacagggtgcatc

SEQ ID NO: 54412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtacacatcacacgaatgacgggaaatcg

SEQ ID NO: 54413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtaccaccacctccggtactcacagcgcg

SEQ ID NO: 54414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtaccattctacaggaggtggtggttatc

SEQ ID NO: 54415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtacgcggcgtggcgggcaaacctacata

SEQ ID NO: 54416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtacgggagttagcatttggtcctacttt

SEQ ID NO: 54417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtacgtgcgaattgaagtcttcttgtgtc

SEQ ID NO: 54418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtagagacacctattcgtttccgggtcgg

SEQ ID NO: 54419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtagcggcacctatctacgtcttgatccc

SEQ ID NO: 54420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtaggcagaactaaggaacagcgagctcg

SEQ ID NO: 54421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtaggtcacctctttgtgctgtcctatga

SEQ ID NO: 54422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtatcgcctccgcttgacaatgcgtgtag

SEQ ID NO: 54423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtatcggcgttctgggtgttttaaaggcg

SEQ ID NO: 54424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtccatttcgggagtagtggcgtgtgttc

SEQ ID NO: 54425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtccccgtcgtgcgcacaagttgtgtgag

SEQ ID NO: 54426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtccgatttgagttggtaaataccggcgg

SEQ ID NO: 54427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtccgtcaggcagcatttggtagggcgtc

SEQ ID NO: 54428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtcgcgctaatcttgcatttcaggtcagc

SEQ ID NO: 54429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtcgggcgccctgcgctgtgagttcaggg

SEQ ID NO: 54430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtctatatttttgagggttcctggggtgt

SEQ ID NO: 54431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtctcacgccaagagggacgcacggtgca

SEQ ID NO: 54432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtctgggctatacgataacataaaagggt

SEQ ID NO: 54433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtgaaaattcttgcttcttgtactcatca

SEQ ID NO: 54434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtgaccgagaacgtatgtagctcacttga

SEQ ID NO: 54435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtgatactccaaagtcaagtatgttgcct

SEQ ID NO: 54436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtgcgcggagccgcgtcatgttcggaatg

SEQ ID NO: 54437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtgctcgcacagtctgggtctagggtggc

SEQ ID NO: 54438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtggaacgctttccggcccgggtgcatgt

SEQ ID NO: 54439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtggctcttatgtcttgacatgggggggc

SEQ ID NO: 54440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtggggaactaaagattcttccggaacgt

SEQ ID NO: 54441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtgtaaccatccgatagtcatggtcttcc

SEQ ID NO: 54442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtgtatatgtctatcttacgctactgctc

SEQ ID NO: 54443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttaaggcttattagttcgctcggtgttc

SEQ ID NO: 54444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttaagtaatacatgttccggttagtgtt

SEQ ID NO: 54445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttagaaacagggatatggggtttgtgtt

SEQ ID NO: 54446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttagccgtttgctctagtctgacggtgc

SEQ ID NO: 54447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttcctacaggatatcaaaggccggtaac

SEQ ID NO: 54448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttcgacgtgtaagtctgtgcgaatgatg

SEQ ID NO: 54449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttcgttcgcatatacgaaaggcttcgac

SEQ ID NO: 54450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttctagattccgagttacgattcgagct

SEQ ID NO: 54451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttctaggcggggtatcagtggctacgta

SEQ ID NO: 54452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttgcatcagtgaggctgggtagatggtc

SEQ ID NO: 54453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttgccgcacaacgcagtgcacctgattg

SEQ ID NO: 54454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttggacgttatagacgaacgtagggtag

SEQ ID NO: 54455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttgggctccgtgactttacctgtgccgc

SEQ ID NO: 54456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttgtaacggttaaaggggactctcgggt

SEQ ID NO: 54457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttgtttattcatatactgtgtacgggcg

SEQ ID NO: 54458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtttagtctcgtatatacgcatcgcgagg

SEQ ID NO: 54459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtttccgacctttgacatcacacttctcc

SEQ ID NO: 54460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagtttggtgtgattgcgcatctgaagcgag

SEQ ID NO: 54461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtagttttcaagccactgctagctatacgtgg

SEQ ID NO: 54462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtataacgagtggggccgttgtgcgatcaagt

SEQ ID NO: 54463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtataatgatttccaacccagttaacgctttt

SEQ ID NO: 54464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtataattgggatctatacgggagcgaggatg

SEQ ID NO: 54465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatacacaatagcaaatcgaaatcactcggc

SEQ ID NO: 54466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatacagtccaatttgtgacgcgtcgatcga

SEQ ID NO: 54467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtataccgcacagtaccatcacaggccggggg

SEQ ID NO: 54468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatacgatcgcaaccatgcgggagagctttg

SEQ ID NO: 54469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatacgcgtaagggattcaccgtattgtgcg

SEQ ID NO: 54470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatacgctggtgtccgcaaaaggatacgagg

SEQ ID NO: 54471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatacggaaacgcgccagagccatgaattgg

SEQ ID NO: 54472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatacgggcggcgcctgagggatgaagacgt

SEQ ID NO: 54473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatacggttgcgcagcacttggattgtatct

SEQ ID NO: 54474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatacgtgcattgggctcctaatggcgcacg

SEQ ID NO: 54475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatactaaccgaggggtcggtcgtttcttgg

SEQ ID NO: 54476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatactcctggaggcatctttggccggcacc

SEQ ID NO: 54477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatactggccttgtttagaggctgagcatgt

SEQ ID NO: 54478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatacttaaactacgcgccgctaatttggcc

SEQ ID NO: 54479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatagacattgttacgtcaagaggggatctg

SEQ ID NO: 54480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatagactttactgccgcgtgtccctggatt

SEQ ID NO: 54481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatagatacgcactatggcatctcgtgcagg

SEQ ID NO: 54482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatagatatgagctagtgtccgtgtgaatca

SEQ ID NO: 54483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatagcccgggttcttttgatgccgtgcttc

SEQ ID NO: 54484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatagctaatgggactacccagtgcatacgg

SEQ ID NO: 54485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatagggctttagcctccagtttccaccatg

SEQ ID NO: 54486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatagggtggacgactgggacggtagcgtcc

SEQ ID NO: 54487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtataggttgcgtgggtggcagtgagtgagcg

SEQ ID NO: 54488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtataggtttcgggtctgaattcatattaaac

SEQ ID NO: 54489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatagtggacccaagggaagttacattgcga

SEQ ID NO: 54490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatatcgggtaccgaggcctactctcgcgct

SEQ ID NO: 54491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatatctagagtggtcgttacagagtattta

SEQ ID NO: 54492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatatggccacattggatacgcacacggctg

SEQ ID NO: 54493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcaaagcgaaatgagctcgaactacaatt

SEQ ID NO: 54494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcaaaggactgcgccggcacattgtcagg

SEQ ID NO: 54495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcaaggtttggtatgggtcctaaaatggt

SEQ ID NO: 54496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcaatagtcatggttgcccgagcccgcgt

SEQ ID NO: 54497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcacacgggttcgtcaatcgtcaataatg

SEQ ID NO: 54498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcacaggtcacacgcctctattacgattc

SEQ ID NO: 54499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcacctgacctactcggaaatgggtctcc

SEQ ID NO: 54500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcacgagtgtgaatgggggtggtggatcg

SEQ ID NO: 54501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcagcggttacatcccatgcaacagttga

SEQ ID NO: 54502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcagggggattcgtacgacgagtaagagg

SEQ ID NO: 54503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcaggtcgcgtgggtcccagctggtgccg

SEQ ID NO: 54504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcagtgccaaagtgctttaatttaaggtg

SEQ ID NO: 54505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcatacgtttttgcaccgcctcgcgtaag

SEQ ID NO: 54506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcatcagatctacgtgcgctgggtgcgtc

SEQ ID NO: 54507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcatcccacatctggtaatttatcgtggg

SEQ ID NO: 54508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcatctgcacgttggaatggatgacggga

SEQ ID NO: 54509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcatgctccttcggataaatggccactag

SEQ ID NO: 54510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcatggctcagggtggcctcgtatcctgg

SEQ ID NO: 54511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcatgtctgtctcgcgtccactatagtct

SEQ ID NO: 54512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcattcatggcgagtttacctaacacggg

SEQ ID NO: 54513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatccacaggctggatccgacacgaagcgcg

SEQ ID NO: 54514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatccagcttcctggggcttggcagtgatac

SEQ ID NO: 54515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatccatcttcatgcaggccctagacctctt

SEQ ID NO: 54516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcccataagtccttctttgatagcttaaa

SEQ ID NO: 54517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcccccggacagtattttcttgcttgcct

SEQ ID NO: 54518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcccgccttaagagtatggggtgacggct

SEQ ID NO: 54519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcccggcacccggcatggtttcagtcgtg

SEQ ID NO: 54520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcccgtcaaacaggtctacacctatcggt

SEQ ID NO: 54521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatccctagaggcttcagtccatcccttgct

SEQ ID NO: 54522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatccgacgcgagtataaggatctgggagct

SEQ ID NO: 54523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatccgacgggctgttgtcttgacctgtact

SEQ ID NO: 54524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatccgccgcagtccgtatccttcctagagc

SEQ ID NO: 54525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatccgcctgcggttactgacgttacgttga

SEQ ID NO: 54526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatccggagtctagaacaataaacgtacgag

SEQ ID NO: 54527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcctcatattaaggtgtttgggtccgttt

SEQ ID NO: 54528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcctccgggttggcgttcatctggtggcc

SEQ ID NO: 54529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcctgaatagtggtgaccaattgctcggc

SEQ ID NO: 54530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcctgagggttatgatctggctgtggcgg

SEQ ID NO: 54531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatccttttcaattttgctacggtacgccga

SEQ ID NO: 54532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgagaggaacattcttgtccgtgtcctt

SEQ ID NO: 54533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgagctgattcaccggagtgccatagca

SEQ ID NO: 54534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgatgacaataatttgtttcaatgtttc

SEQ ID NO: 54535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgcacaaacaacgatggttccttgcgtt

SEQ ID NO: 54536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgccggccgctgtgaggaactggctcat

SEQ ID NO: 54537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgcgtctgaagtggtatcatgagcaagc

SEQ ID NO: 54538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgctaaagtttgggaacttctccttcgt

SEQ ID NO: 54539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgctcataggtacggacctattttcagc

SEQ ID NO: 54540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgctgacggagtacccttcactcgccac

SEQ ID NO: 54541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcggagaagcgttcttcttaagcaggatc

SEQ ID NO: 54542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcggcgcctttaggttaccaccatcgtcc

SEQ ID NO: 54543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcggcgggcatctaccattctataatggc

SEQ ID NO: 54544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcggcggtgcattcgcctgtgggttgagc

SEQ ID NO: 54545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcggcttgatcttggcgggggtaggtgcg

SEQ ID NO: 54546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgtattggcctcccgattgggttcccac

SEQ ID NO: 54547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgtgactacattgttctttcgtttggtc

SEQ ID NO: 54548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgtgccaactgattgtgtgtcggtgggc

SEQ ID NO: 54549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgtgcttgagccttgacgcacacgattg

SEQ ID NO: 54550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgttgaacaattgcaccgcaatggctcc

SEQ ID NO: 54551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatcgttgtatttaacaacattctcgtttaa

SEQ ID NO: 54552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatctattggggactgcaggatgaaggatcg

SEQ ID NO: 54553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatctccgacaatccactgtcaagctgtctg

SEQ ID NO: 54554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatctctcatcgcgatttacgacgcctgggt

SEQ ID NO: 54555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatctgatgaaagtccttcgccataagcttc

SEQ ID NO: 54556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatctgcacctgcttccgcggctgcccacgc

SEQ ID NO: 54557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatctggctccaggggtatctctctgtagcg

SEQ ID NO: 54558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatctgtctgcaatggcccagtttatcatcc

SEQ ID NO: 54559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgacatcacaaggtgtgggccagtcggtc

SEQ ID NO: 54560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgacattggactgtgcggccacatctgag

SEQ ID NO: 54561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgagctggcatgtcattttagcggtcaaa

SEQ ID NO: 54562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgagtgctttgcccgtcaacctacctaag

SEQ ID NO: 54563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgataaccgtctattgatcgcgggtttct

SEQ ID NO: 54564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgatacgggacgattatttgatgttccct

SEQ ID NO: 54565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgataggatattaaatgctggttactgtc

SEQ ID NO: 54566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcaatcgaaggccgtatcgtcccttccc

SEQ ID NO: 54567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcacgcgcagtttctttgtttttcgggc

SEQ ID NO: 54568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcagagccacattggccagttctacacg

SEQ ID NO: 54569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcagccatagatcttggtcgaacgaaat

SEQ ID NO: 54570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgccatcggaatgttcacgccaactcggc

SEQ ID NO: 54571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcccattacctgttcgtgatgttggacg

SEQ ID NO: 54572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgccctagaatgtcacgtgttcgattagc

SEQ ID NO: 54573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgccgttgaggttaggttttgaccgctgt

SEQ ID NO: 54574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcgatttcggcaaggtatctagtgtctt

SEQ ID NO: 54575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcgcatcgggatagattgtatatagtgc

SEQ ID NO: 54576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcgcgcgtgtgaaaaggctttgcgtttg

SEQ ID NO: 54577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcggaatggaagggtctgacatggcctc

SEQ ID NO: 54578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcggagacgcgggacaaatgccggcgcc

SEQ ID NO: 54579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcggcagttaaaaacgacatgggccggt

SEQ ID NO: 54580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcggcgagcaggcgtatggggcctcggt

SEQ ID NO: 54581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcgggcgacgcacagcgacgatgtgagg

SEQ ID NO: 54582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcggggctacggcgtaggggagatagtg

SEQ ID NO: 54583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcgggttctacaactagctcttactgta

SEQ ID NO: 54584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgcgtttcgaaccactagctgtttgtgcc

SEQ ID NO: 54585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgctcaaggcctcgactctgcacgttccg

SEQ ID NO: 54586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgctctaatccgcatcacgggctgttcgt

SEQ ID NO: 54587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatggatcacgcttttcttggagcatcctca

SEQ ID NO: 54588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatggcaaaggacccgcttcgatggtccgca

SEQ ID NO: 54589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatggcgttgaactgcgacacagaaggctag

SEQ ID NO: 54590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatggcttacgcatgttactagacccggcaa

SEQ ID NO: 54591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgggaaaagtggagctacctctgacccgt

SEQ ID NO: 54592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgggaaaatcgtaccgcttaccgggtttg

SEQ ID NO: 54593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgggaaatcgtgtgagtctttcggtcgga

SEQ ID NO: 54594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgggacggtgcaagttagaggacctgact

SEQ ID NO: 54595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgggactttgttttgggcggtacgtgttc

SEQ ID NO: 54596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgggcacaggattactccgggcacgtgag

SEQ ID NO: 54597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgggcggccaaagagacgcttggttcgtg

SEQ ID NO: 54598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgggggactcgccacggtggagctccgca

SEQ ID NO: 54599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatggtcggagggcgccgaatcatatctcac

SEQ ID NO: 54600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatggtctttacttaagaaaggttatgactt

SEQ ID NO: 54601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatggtgagaaggctaacgggtcatcctgtt

SEQ ID NO: 54602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgtaaagcactcgtggcggtggaggctca

SEQ ID NO: 54603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgtacctggaccatcttatcctcggggtg

SEQ ID NO: 54604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgtacgcattgagcgagcaatctagctga

SEQ ID NO: 54605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgtatcactttacttcgccgttgaagggg

SEQ ID NO: 54606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgtcggccgtctttacgcgtcgcctatcg

SEQ ID NO: 54607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgtcgttgttgtcccacaaagggtagcta

SEQ ID NO: 54608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgtctgctgatcaaggtttttcagttatc

SEQ ID NO: 54609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgtctggcgtctgacgtgaaaccacagta

SEQ ID NO: 54610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgttaggtcggcagaccacgcagttggtg

SEQ ID NO: 54611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgttcggcttgggcaagcatcgcggaaat

SEQ ID NO: 54612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgttgatatatgcttgcccggtcaggggc

SEQ ID NO: 54613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgttgttagtcttagggtctgtacgggcg

SEQ ID NO: 54614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatgtttgtcctgacaatgttactcataccg

SEQ ID NO: 54615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattaaccgaagttcacggcctccacgtatc

SEQ ID NO: 54616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattaacctcgagcctcggcgtactgcaccg

SEQ ID NO: 54617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattaacggtgggtctcttataaacgctccg

SEQ ID NO: 54618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattacatggccattgtatgtgggtattaga

SEQ ID NO: 54619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattacgtcactgcatgctatttattctgcg

SEQ ID NO: 54620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattacgtcggagcggttatagcggatacac

SEQ ID NO: 54621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattactttacctatgcggccgtgccacgtg

SEQ ID NO: 54622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattagacaatgggctcggaaactagcgagg

SEQ ID NO: 54623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattagagctgtatcgcgttgtgccattttg

SEQ ID NO: 54624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattaggcttgttgtgccgtcaaggcggggt

SEQ ID NO: 54625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattaggtaaaggcaaaatgcactttttggt

SEQ ID NO: 54626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattagtgcgtaccctaggcatattggatcc

SEQ ID NO: 54627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattatacttagaaggcgagtggtgcccata

SEQ ID NO: 54628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattatgacagggtaggcctgagaacgggta

SEQ ID NO: 54629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattcaacatgcgcctcagtgattgatcgtg

SEQ ID NO: 54630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattcaaccttggggaacctcctcgaactct

SEQ ID NO: 54631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattcactgtcggttcctgcaactaacttct

SEQ ID NO: 54632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattccatctcacttgggcttacgatcttca

SEQ ID NO: 54633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattccatcttatttccgttcaagtgtccta

SEQ ID NO: 54634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattccccatgggatccattggcgcggtata

SEQ ID NO: 54635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattccttggcaggatcttccgaacccccac

SEQ ID NO: 54636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattcgatctcggcctcactcatacgtctta

SEQ ID NO: 54637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattcgccacatcaacccgaggtagcgttcc

SEQ ID NO: 54638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattcgcgtaatggtagcttgtttattggcc

SEQ ID NO: 54639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattcggcttggggtggcttgaatttcagca

SEQ ID NO: 54640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattcgtcctgaggacatttgatccagtcct

SEQ ID NO: 54641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattctaagcgtcatttttctcagttgatta

SEQ ID NO: 54642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattctaccgcgccttcacaacgagggggtt

SEQ ID NO: 54643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattctgacgttctgtaccatgtctacttgt

SEQ ID NO: 54644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattctgcggtaaaacatcgggatcacgttg

SEQ ID NO: 54645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattcttaagtcgtgcctcgcgtctactttc

SEQ ID NO: 54646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattgaagggttattggagacgttacagagc

SEQ ID NO: 54647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattgccgaaaactgtaacggactgcggtcg

SEQ ID NO: 54648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattggacaattatcacttgagcgccgacgt

SEQ ID NO: 54649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattggctatatccggcttatgattattggc

SEQ ID NO: 54650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattgtattcgggcctagcaattcccggttg

SEQ ID NO: 54651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattgtgaagcctgggggcattctcttgccg

SEQ ID NO: 54652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattgttggtccgactcttgatgtgtcatct

SEQ ID NO: 54653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatttaatccctacaacgggtttaggttacc

SEQ ID NO: 54654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatttaccactccattccggactacgcgcga

SEQ ID NO: 54655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatttagcatattgtaatactggaaggtgcg

SEQ ID NO: 54656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatttccaagtaccgttttgcccctaggtta

SEQ ID NO: 54657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatttctatctcaggtgctgacccacaagga

SEQ ID NO: 54658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatttggtgctttttctgttcgggtctttgt

SEQ ID NO: 54659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatttggtggtctggccggcggattgcacgg

SEQ ID NO: 54660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatttgtaggacggcggagccctacgagcat

SEQ ID NO: 54661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatttgtatgatggtccctggtcgctatgga

SEQ ID NO: 54662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtatttgtattgtatggttatgtaaggatgtg

SEQ ID NO: 54663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtattttctgcaacctttaacattgtcagacg

SEQ ID NO: 54664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaaacggctgcgtcaagggtggtccgcgt

SEQ ID NO: 54665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaaatcctcataggcagggtattctctta

SEQ ID NO: 54666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaacgccgtattcttgatatttcgaggag

SEQ ID NO: 54667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaagatcgatttcccggtgagagcggtct

SEQ ID NO: 54668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaagcatgctaagatatgtgttttcacgt

SEQ ID NO: 54669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaagcattcagacgctatgctgcagaagc

SEQ ID NO: 54670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaaggaacggcaatgagcaacattggtag

SEQ ID NO: 54671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaatccctcgtacgattagggcgacattg

SEQ ID NO: 54672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaatcgcgagtagcacggtccaggcgagg

SEQ ID NO: 54673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaatcgcgcgggtatgggaggtaggacaa

SEQ ID NO: 54674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaatcttctacctcgtgctggtggtcatg

SEQ ID NO: 54675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaatgcagtgatagttgatcaccctacgg

SEQ ID NO: 54676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacaacgccataaatattcagctgttctt

SEQ ID NO: 54677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacaactcgcagtcctctactcccgcccg

SEQ ID NO: 54678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacaactgacataagacctcagactagtg

SEQ ID NO: 54679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacaagggttcttagaaatcctatgatgt

SEQ ID NO: 54680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacacccgttttatgcgggcatcctgtag

SEQ ID NO: 54681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacaccctcatctgtgtatgtacgagtgc

SEQ ID NO: 54682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacacgcagcaagaggccatgggtgctag

SEQ ID NO: 54683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacactgccgacttgcagttaaccttggt

SEQ ID NO: 54684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacagagtagaatcagacaattcggctta

SEQ ID NO: 54685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacagggactagcttcgccttcatgatgg

SEQ ID NO: 54686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaccaacgtttatccccaactaacgtaag

SEQ ID NO: 54687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaccgatgggtacagcatgcacagtgagg

SEQ ID NO: 54688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaccgcctttgattggggctgggggcgga

SEQ ID NO: 54689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaccggataacgacgaccgagtggcccat

SEQ ID NO: 54690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaccggccggatcccagagataaagtgcc

SEQ ID NO: 54691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacctacttccttcaagctcatgacctaa

SEQ ID NO: 54692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacctcgtttaaaatactgcctcgtgcgg

SEQ ID NO: 54693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaccttcaacgggctcgcatgctgacgct

SEQ ID NO: 54694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacgagatgtcttcagcgcggaccagtgg

SEQ ID NO: 54695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaacgcgtgatgaagcccataggccgccac

SEQ ID NO: 54696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaactcacttacttcgaagccgtacgtcac

SEQ ID NO: 54697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaactcagggtgaaagcaacaactagccgg

SEQ ID NO: 54698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaactcattcagactacgccgcggtccggt

SEQ ID NO: 54699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagacaatgcgggcccggcactcggagtg

SEQ ID NO: 54700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagcaattgcgggtttagagtaaggttag

SEQ ID NO: 54701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagccggttttttgactgcgatcggttac

SEQ ID NO: 54702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagcgagtgccggtttgtaatttagcatg

SEQ ID NO: 54703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagctcgatctcagtgagacacatcttca

SEQ ID NO: 54704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagctgactagcgggctttgttctcgagc

SEQ ID NO: 54705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagctgatgcacagtgacgaaacggcgtg

SEQ ID NO: 54706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagcttagtcgactaaggtaacacgtgcc

SEQ ID NO: 54707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagcttggtagtggtcgcattgatgggct

SEQ ID NO: 54708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagctttgcagagttcggcgaaaaacacc

SEQ ID NO: 54709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaggcacgatgaaaaacggatacggtcgg

SEQ ID NO: 54710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaggctggtgtcccggtacactccactct

SEQ ID NO: 54711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagggcagggttcgaatgattcgcctcct

SEQ ID NO: 54712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaaggttgcgtatctgcactcttctagtaa

SEQ ID NO: 54713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaagtatcttggcaggctgatccaggctcg

SEQ ID NO: 54714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaataaactagacaggtgttcgtacgtttg

SEQ ID NO: 54715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatagaggggagatagctgaaaccccccg

SEQ ID NO: 54716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatagctccggcttccagaggggctctgt

SEQ ID NO: 54717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatatgttgaagtgggcggatccagggag

SEQ ID NO: 54718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatattccaaaccccgctctgttagtgtt

SEQ ID NO: 54719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatcacgagaaagcgtgccttctgtttcg

SEQ ID NO: 54720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatcctttcctttttgacgtgatttcgga

SEQ ID NO: 54721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatcgtatcgtgctcttgggcctactcgc

SEQ ID NO: 54722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatggagtaggaacctcgtgcgcctctgg

SEQ ID NO: 54723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatggcccttaggcttcacgtttcaggac

SEQ ID NO: 54724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatgtggataatttaccatgtggcaatgg

SEQ ID NO: 54725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatgtttcgacgtctggctatattgcgcg

SEQ ID NO: 54726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaattacaagaaagacgttggtcatcctta

SEQ ID NO: 54727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaattggcggcagggttcagtttctgtagg

SEQ ID NO: 54728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaatttggcggtgcggaataagcagcaaag

SEQ ID NO: 54729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacaactcttgcgagccttccactacagta

SEQ ID NO: 54730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacaactgaagtttaaagcaagctgccggc

SEQ ID NO: 54731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacaatccatctcgtgtaggctgacgttac

SEQ ID NO: 54732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacaatggtacctcctagctcgcgtcgatt

SEQ ID NO: 54733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacacaaccgccaccacgttgttcgcgtgt

SEQ ID NO: 54734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacacaaccttgattatgttcgtgttcggc

SEQ ID NO: 54735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacacatatgaggctcccgaggactgtacc

SEQ ID NO: 54736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacaccgatgctacgtagcggtcgcgcgac

SEQ ID NO: 54737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacacgcggtcgtaggttggctattgtcac

SEQ ID NO: 54738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacacgcgtctgcgggcgaggtgctcgatg

SEQ ID NO: 54739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacactttatgtccttctctcgtactcttt

SEQ ID NO: 54740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacagcaacgatgtccggcgctgaaagttt

SEQ ID NO: 54741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacaggaggaggtatatggtggcacatcaa

SEQ ID NO: 54742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacagggaggaggtccgttgcgtagtgggc

SEQ ID NO: 54743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacaggtcgcatcacgagcttgcttagcta

SEQ ID NO: 54744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacagtcctcctgtaggatcctcatcgcca

SEQ ID NO: 54745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacatcaggctaatctttccagcggccgag

SEQ ID NO: 54746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacatcatatgcagctcttcgttggtcctg

SEQ ID NO: 54747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacatccaggcctcgaactcccttatccgt

SEQ ID NO: 54748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacatgaaccttgcgtaagatagggccgtc

SEQ ID NO: 54749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacatggcgtttaccgggggcagcgttcca

SEQ ID NO: 54750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacatttcaagcccttcgcccctagcgtca

SEQ ID NO: 54751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccacaaacctccgtacttattcgtctgc

SEQ ID NO: 54752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccacggtccctgggtcttgctagaatcc

SEQ ID NO: 54753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccaggggttagcgatcgagcccacatta

SEQ ID NO: 54754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccagtcattcgactccatttgtgatggc

SEQ ID NO: 54755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccatctgcacatattatttcgtcaaagt

SEQ ID NO: 54756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccccggtcttgtgctataagtttcgacg

SEQ ID NO: 54757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacccgcagcgactgcgttctacggacgat

SEQ ID NO: 54758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgaattaggtttcggtgtcggggtgct

SEQ ID NO: 54759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgaggctaaggtttggtactgtcgatt

SEQ ID NO: 54760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgatactttgttttatgctcacgtttt

SEQ ID NO: 54761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgcagtagctcggcgccgagtaatctg

SEQ ID NO: 54762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgcccaggatcactcccagtagcgtgg

SEQ ID NO: 54763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgcggacacgggaccttgcggtcattt

SEQ ID NO: 54764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgcgtgtttaaactgttcagtccggca

SEQ ID NO: 54765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgctatgccgcttgtgggacttgtggc

SEQ ID NO: 54766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgggcggctttataaacagacgcatcc

SEQ ID NO: 54767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccggttgtaaggttgacttctttcatgg

SEQ ID NO: 54768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgtacctcgcgggtgctcttcctcctt

SEQ ID NO: 54769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgtccgtgttacctcaactgcgggatg

SEQ ID NO: 54770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccgtcttgattcaatgaggtaacttgtg

SEQ ID NO: 54771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacctcaatcgctcactgccaaggcccagg

SEQ ID NO: 54772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacctcccaattatcagatgaatgcgtgct

SEQ ID NO: 54773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacctcctagtgcgtttcacgtttgaagat

SEQ ID NO: 54774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaccttccacgtcctcgagacccttcatta

SEQ ID NO: 54775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgaacacaaccgaaatcagcatcgtaac

SEQ ID NO: 54776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgacatacggaatcgcggtatcaagagt

SEQ ID NO: 54777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgacatatgctatccttggcctgaattt

SEQ ID NO: 54778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgactcgaacggttacgacggttgcgac

SEQ ID NO: 54779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgagacatcgcggccgagcagcgccccg

SEQ ID NO: 54780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgagtgagtggaagatataaactgtctc

SEQ ID NO: 54781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgataaaaatcatttttaaattaccagg

SEQ ID NO: 54782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgcaacgcggcctgtttttccaatgttg

SEQ ID NO: 54783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgcactctagaacacatgggtttggtat

SEQ ID NO: 54784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgcaggactcaacgagtgatggccgtta

SEQ ID NO: 54785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgcctatgcgcagataagccggcaagtc

SEQ ID NO: 54786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgcctgaatcacgataccgttccatggg

SEQ ID NO: 54787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgcgaagagagcggtcctcccgtgcggt

SEQ ID NO: 54788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgcggagagcgagccttggacgttatac

SEQ ID NO: 54789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgcggtcaaagccaaatcctggtcttgg

SEQ ID NO: 54790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgctaatgtcttgccaatggttcggagt

SEQ ID NO: 54791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgctcatgttcaattccccaatcgcagc

SEQ ID NO: 54792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacggaaactccatcgtcaggagcaagtga

SEQ ID NO: 54793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacggagctgtgtgggttctttcggagggc

SEQ ID NO: 54794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacggcataattcctgcgcgttggcaaatg

SEQ ID NO: 54795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacggccaacggtcaacgcggtccgccgcc

SEQ ID NO: 54796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacggccgcgtttggagaccaggcatggcc

SEQ ID NO: 54797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgggaccagctcgccatcctcggggtcc

SEQ ID NO: 54798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgggatcgctcggtgaatctttaagcat

SEQ ID NO: 54799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacgggttattaatggctgattcccggtcg

SEQ ID NO: 54800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacggtaggcaaggttgaatgcaccgctcg

SEQ ID NO: 54801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacggtcgttttcgaatgagacgtaacgac

SEQ ID NO: 54802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacggtgtatgatggttgatcgacccgggg

SEQ ID NO: 54803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcactagttacggaccgccgtcagctacctt

SEQ ID NO: 54804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcactcgagtatccgcgtaccgggctttttt

SEQ ID NO: 54805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcactcgggtaggatcaatagtacttatccg

SEQ ID NO: 54806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcactcggtgcttaacgttggtttcatggct

SEQ ID NO: 54807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcactctgtcaacgcatgcatacagcggcgc

SEQ ID NO: 54808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcactgagctgggcggatggcatgtgcgttg

SEQ ID NO: 54809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcactgattgcatgggccatcaagaagcgag

SEQ ID NO: 54810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcactgcaaccgggtttagtcttttggagtg

SEQ ID NO: 54811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcactgctctcgaggtcttcagtactcccat

SEQ ID NO: 54812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcactggcctcgcggaatcgctaaggtaggc

SEQ ID NO: 54813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcacttggggcaaaattacccgtatcccggg

SEQ ID NO: 54814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcactttctacgatagcaaaaatgcgtcgcg

SEQ ID NO: 54815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagaacaaggccagtctccagtaacgcgcc

SEQ ID NO: 54816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagaacacccgttcgtgtagttcgcgattg

SEQ ID NO: 54817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagaacccttacgcgtgtgtctgtgccgca

SEQ ID NO: 54818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagaagcgtttcaccgcttatgtacgtgca

SEQ ID NO: 54819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagaaggggggctttgtcatgctagctgag

SEQ ID NO: 54820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagaatgttaatattaccgtcgctcccctt

SEQ ID NO: 54821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagaattctcgtacagagtgcaacatctcg

SEQ ID NO: 54822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagacccgccgattaaggatgacacgcggg

SEQ ID NO: 54823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagacgaggggacgcacaggtcttgactgg

SEQ ID NO: 54824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagacggattgaatgattggggctgttggg

SEQ ID NO: 54825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagacgttaacttgctgggttttcctggtc

SEQ ID NO: 54826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagactttctagatctcctggtccgaatgg

SEQ ID NO: 54827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagagatcgttgccctctgctctcccctgg

SEQ ID NO: 54828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagagccacccgcgtacggaatcattgttc

SEQ ID NO: 54829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagagcgggtacagctggatcttccttctt

SEQ ID NO: 54830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagaggcgcgtcggtgagacctaagttcta

SEQ ID NO: 54831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagagggcatcagattatggagcttaatta

SEQ ID NO: 54832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagataacggccaacggcgcctactgccca

SEQ ID NO: 54833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagatactcaatcttattagcttcccagga

SEQ ID NO: 54834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagatatttatgcgcttgcggctcatctca

SEQ ID NO: 54835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagatgattggaggatttatgatagacctc

SEQ ID NO: 54836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagattcgggcgcgtgaatattcatcctcg

SEQ ID NO: 54837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcaaacgtctggcaacttacagatgatt

SEQ ID NO: 54838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcaacttagccaatagcggccaatcacg

SEQ ID NO: 54839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcacgttatgagcggcaacgccattggg

SEQ ID NO: 54840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcaggcgtcgtcgccatcgctgccgtcg

SEQ ID NO: 54841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcagtttgtcggtcgttggaacgtcgtg

SEQ ID NO: 54842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagccagacaaacgactaaagggtggtaag

SEQ ID NO: 54843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcccacacgcgtgaagtcatgccgggtc

SEQ ID NO: 54844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcccagcgatcaaaagtagccggtatta

SEQ ID NO: 54845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagccgtgaagaccattttacgttattcct

SEQ ID NO: 54846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcctgtagagagcctaaacggatcggtg

SEQ ID NO: 54847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcggaacaacaaagagtggacttggagc

SEQ ID NO: 54848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcgggtatttccttgcgcgtttcaattt

SEQ ID NO: 54849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcgggtcaacccgactggagttgttcgt

SEQ ID NO: 54850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcggtcagggaatgaccaaagaatatcc

SEQ ID NO: 54851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcggtttctcacccatgctctatgtctg

SEQ ID NO: 54852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcgtcaggacctaaatcgtccaggggcg

SEQ ID NO: 54853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcgtcgaacacatactcgactgggtccc

SEQ ID NO: 54854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcgtcgcctggctagcctctggcctggg

SEQ ID NO: 54855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcgttcttgtccgcgtccggtcttaacc

SEQ ID NO: 54856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcgttttctgcaatcttttcgaccatga

SEQ ID NO: 54857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagctaccttgtctaccttttactctatcc

SEQ ID NO: 54858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagctccggtctgcaaggcaatcggggtgg

SEQ ID NO: 54859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagctcctcggcggggaaggcagtgtggcc

SEQ ID NO: 54860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagctgattaggaaggtttggcgtgtcagg

SEQ ID NO: 54861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagcttatgaggcagctaggcgttcagtcc

SEQ ID NO: 54862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggaaggatataccattagtttgcagtta

SEQ ID NO: 54863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggagatgttgggagtgtctgtggttgag

SEQ ID NO: 54864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggatcttggtcttctcgttacgctcatg

SEQ ID NO: 54865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggatgtgtgggggatccttggcacggtt

SEQ ID NO: 54866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggattgtagttcgcttcgtattcttgtt

SEQ ID NO: 54867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggcaagttcggtgcgttcacgtttgtcg

SEQ ID NO: 54868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggcagcaggatacgagaggttgggcaag

SEQ ID NO: 54869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggcatgtcaccgatacgcccccaaaggc

SEQ ID NO: 54870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggccaggactcgggggtgcgtttgggtc

SEQ ID NO: 54871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggccattggtcacgaaccaaaagttccg

SEQ ID NO: 54872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggccgaactacacgtgcgcatcgtgtgg

SEQ ID NO: 54873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggcgctggaactgactgagctggagtgt

SEQ ID NO: 54874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggcggctttggctaggacgatgagtcgg

SEQ ID NO: 54875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggcttctatattcggcacagattcgcaa

SEQ ID NO: 54876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggctttagtttcttgcctaggggtccgc

SEQ ID NO: 54877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagggatagcacgtgtctgtcttgaatcct

SEQ ID NO: 54878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagggcaagtgaggctcgatcgagcgcaag

SEQ ID NO: 54879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagggccattaggtagaaatacggacactt

SEQ ID NO: 54880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagggcgcgcaggcctaattattggcatga

SEQ ID NO: 54881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagggcttcgactacgcttccattgaacac

SEQ ID NO: 54882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggggccaagaggaatccatgctaactgg

SEQ ID NO: 54883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggggtttagtcattccaaggtccacgct

SEQ ID NO: 54884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagggtcgctatggcactagtcgggcgcta

SEQ ID NO: 54885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagggttttgattaaagatgtgcgtaactc

SEQ ID NO: 54886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggtactacagtcaggccgttgatcaccg

SEQ ID NO: 54887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggtagtcgtgccgggattaactcgggct

SEQ ID NO: 54888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggtctaatccgttccgcgtgtggtacgt

SEQ ID NO: 54889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggtctagcataaggtgtggggacgggcc

SEQ ID NO: 54890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggtgcgacgacttcttccgccttgcttc

SEQ ID NO: 54891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggtgcggcgcgaagccaggtcgaagaat

SEQ ID NO: 54892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggtggccggtgctgaggtaaccccttca

SEQ ID NO: 54893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggtgttcacctagctgccaggtttaaag

SEQ ID NO: 54894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcaggttgttatttttgcgagggatgtgtga

SEQ ID NO: 54895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtaagggttcttactcggcatttgggat

SEQ ID NO: 54896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtaatgtagtgaactactgctgattacc

SEQ ID NO: 54897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtacagcagttaatgtccggtctatctt

SEQ ID NO: 54898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtccacgtgacaattctgcggttaggtt

SEQ ID NO: 54899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtccaggtagtcatcttgcagcgttttg

SEQ ID NO: 54900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtcgatgtcagtcgaccggttaggtctg

SEQ ID NO: 54901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtcggatgacctgtttatagccttggga

SEQ ID NO: 54902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtgaacgataaacgcgaagtaggagcgc

SEQ ID NO: 54903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtgatgcatggcgcaccgtggcggcgtt

SEQ ID NO: 54904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtgccagggagagtgaacgcaacgttac

SEQ ID NO: 54905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtggccgagtggaatggggcggtcacga

SEQ ID NO: 54906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagtgtgcggcttaactatggctgactccg

SEQ ID NO: 54907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagttagggcttcgtactgctcgctcgcct

SEQ ID NO: 54908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagttgatcagatgattccgttggcgttct

SEQ ID NO: 54909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcagttgcgccgtgaagttgtagattttggt

SEQ ID NO: 54910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcataatagtttcgaatccattggaatgatt

SEQ ID NO: 54911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatacaatcttatggaaagccggacgctgg

SEQ ID NO: 54912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatacaggcggagtggcggtgtggacacga

SEQ ID NO: 54913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatacatacgggtatacttgtttgatgtcg

SEQ ID NO: 54914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatacatctccgaggattctcttcctggtc

SEQ ID NO: 54915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcataccaccaaacattttctcgagggacta

SEQ ID NO: 54916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatacgattggaccgaggcccgccaagtct

SEQ ID NO: 54917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatacgtccttaatcggcgggctatggagc

SEQ ID NO: 54918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatactggaatacattttattttttggcgt

SEQ ID NO: 54919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatagacttttaacggtaaattcatttttc

SEQ ID NO: 54920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatagaggggggagaagacttggaccgaac

SEQ ID NO: 54921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatagctagtggttaatttgaatgccaggc

SEQ ID NO: 54922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcataggaattttcttaccggtccgaaaacc

SEQ ID NO: 54923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcataggatgcgtcaagcgtttcgtcgggcg

SEQ ID NO: 54924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatagggggcaccgagttattcttgggttg

SEQ ID NO: 54925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcataggtttcttgttcggtgacatgtggtc

SEQ ID NO: 54926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatatagctggccaccttcttaagggaaaa

SEQ ID NO: 54927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatatatcgtattagtgtccgatgagatag

SEQ ID NO: 54928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatatcactggatgtctggcgcgatagttc

SEQ ID NO: 54929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatcaaggggttccacatttacgcgggatg

SEQ ID NO: 54930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatcagctgacaggagaccagacgtccttc

SEQ ID NO: 54931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatcagtgtagtttggtattcactgttgag

SEQ ID NO: 54932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatcatcaaaaccgttctggatcggcggcc

SEQ ID NO: 54933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatcattatcgacactttaagccttcatga

SEQ ID NO: 54934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatccattaagttgctttcacaacccggga

SEQ ID NO: 54935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatccccgtcaagcctagcgcgtatgcgtg

SEQ ID NO: 54936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatcccgctctgcagtaaggggtattcctg

SEQ ID NO: 54937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatccgagttggcaggacatttagttagta

SEQ ID NO: 54938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatcctggcgaataatttacgggcactcgg

SEQ ID NO: 54939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatcgcgccgatttgttttcagtgattgat

SEQ ID NO: 54940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatcgcgtaaccactacggcaacaatgtga

SEQ ID NO: 54941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatcgtctgttggagattcgatgaggccgt

SEQ ID NO: 54942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatctagccaaatggacctgtgagggatca

SEQ ID NO: 54943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatctcattagggtgcgtaagggagcgctg

SEQ ID NO: 54944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatctcgttccaatgcagtgcgtttgctgg

SEQ ID NO: 54945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatctgaacgatattgaatttcgccgagta

SEQ ID NO: 54946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatcttctctttattttgttgtataaagag

SEQ ID NO: 54947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgaaatcttctcctcgcggccgcaagtg

SEQ ID NO: 54948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgaacgtgtcctggcccatgagcaccgc

SEQ ID NO: 54949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgacacaggacctgcttgcctcatggac

SEQ ID NO: 54950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgaggggcgtccgagcgcaggccttctc

SEQ ID NO: 54951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgcaagggtgacggtaggaggctcaacg

SEQ ID NO: 54952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgcacaacagcgttcattgcttgtatgt

SEQ ID NO: 54953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgcacgcagttctgaatgtcagctattc

SEQ ID NO: 54954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgccgggatgtaatgataagatgttcgg

SEQ ID NO: 54955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgcgaatgcttcgtgcaattgcctttga

SEQ ID NO: 54956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgcgtcaattttctcgtctaatcattga

SEQ ID NO: 54957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgcttttctgtttcgtaaacgaggcttg

SEQ ID NO: 54958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatggattggcgagcgggacttggttaccg

SEQ ID NO: 54959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatggccggtaagtcagtaagtcgtgcagg

SEQ ID NO: 54960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatggcgaggcgacggtgtaggtgcaacga

SEQ ID NO: 54961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatggtaccgtcttaagttcgcagctgggg

SEQ ID NO: 54962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgtgcaaaccgatgagcgtagctgcgtg

SEQ ID NO: 54963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgtggcctgcgttatgaatggaggatta

SEQ ID NO: 54964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgtgtgctcaatggtaaatcatcttagc

SEQ ID NO: 54965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgtgtgtgaatgggttgcacttatctcg

SEQ ID NO: 54966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgtgttaagtttgacttgagtcccttac

SEQ ID NO: 54967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatgttccattacatttattgttaaagcct

SEQ ID NO: 54968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattacgggtgtttctaagtagctccgagc

SEQ ID NO: 54969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattagagaaggcaccaatgatctacgtcg

SEQ ID NO: 54970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattagcacagggctaaaagagttatctag

SEQ ID NO: 54971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattatacaccgccttccgtgtgggggaag

SEQ ID NO: 54972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattatcaccacctcgagcgccattatatc

SEQ ID NO: 54973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattatgcctgtattatagagtcttgccgg

SEQ ID NO: 54974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattcacgaccgggcgcgtgacggttggtg

SEQ ID NO: 54975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattcctttgcgtgattcacacccccgagc

SEQ ID NO: 54976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattctcgtgattagtgtatttcgccggcc

SEQ ID NO: 54977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattgagattctggttcgtgtcgtctttag

SEQ ID NO: 54978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattgcaagctaattagagaaggcgccggg

SEQ ID NO: 54979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattgcgatcggatcgtgtcgtcacgttgc

SEQ ID NO: 54980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattgcgtgatgtagcagcctcctcgcccg

SEQ ID NO: 54981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattggaggtggattggttcgtcaggcgtg

SEQ ID NO: 54982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattggcggtagcttttatcgccttgtttg

SEQ ID NO: 54983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattggctcctatggcaaaaactcggtgca

SEQ ID NO: 54984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattgtgcccatggtcaggcatgtacagcg

SEQ ID NO: 54985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattgtgcgccagtgtgttttcatgtttga

SEQ ID NO: 54986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatttgacgggactacgcatagagccgcac

SEQ ID NO: 54987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcatttgggtatggattgagttcgtgcggta

SEQ ID NO: 54988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcattttcaatgttaacgagtaatcccttga

SEQ ID NO: 54989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaaaagctttcgtgatgtgacgtacgcca

SEQ ID NO: 54990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaaacactgaggaagattggcgtaggtgg

SEQ ID NO: 54991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaaaggattggccggtggaagtttgccat

SEQ ID NO: 54992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaacccgatcgacgggatgtaggcgggcg

SEQ ID NO: 54993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaacgagtacatcatgcggaagcggcttg

SEQ ID NO: 54994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaacgccattcgtcatgatactcctagcg

SEQ ID NO: 54995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaacgtcattgtgaaggttcgccagttag

SEQ ID NO: 54996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaactctacagccgcggaagtcgcccttg

SEQ ID NO: 54997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaacttttatgtatcgttcatagggtgag

SEQ ID NO: 54998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaagctgtgccagtatgtatttttgtgcg

SEQ ID NO: 54999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaaggcggttgagtctgtgcctccgtctc

SEQ ID NO: 55000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaaggcttccctgtagtttgtggtttcgt

SEQ ID NO: 55001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaagggtattgatccgttgggaactcact

SEQ ID NO: 55002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaagttattcgctcaagataggttagggg

SEQ ID NO: 55003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacaagtgggaatcgactagttcagcatc

SEQ ID NO: 55004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacaccaatcagcaaggataagggtcgcg

SEQ ID NO: 55005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacacgcggctcaaaaccacacgaagccc

SEQ ID NO: 55006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacacgcttataccacatagttaacaaac

SEQ ID NO: 55007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacagcttcaatgtatggtaccccgctta

SEQ ID NO: 55008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacaggctgaggtggttcggcgcattcag

SEQ ID NO: 55009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacagggagttaagtgcaaaaactatggg

SEQ ID NO: 55010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaccaatcggaataagtcctggaggagaa

SEQ ID NO: 55011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaccagctcattgaaggtttggcctggca

SEQ ID NO: 55012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaccgcattttctagtctgttgtcctaaa

SEQ ID NO: 55013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaccgccccctgacttggagtaggagggt

SEQ ID NO: 55014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaccgcgaaggctcggacggagagatgaa

SEQ ID NO: 55015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaccgtctcataacgtccgaggtccctcc

SEQ ID NO: 55016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaccgtgttgctcgtccagggatcgctac

SEQ ID NO: 55017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacgaatgaagctacactaaattgcctta

SEQ ID NO: 55018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacgatggcgccctgcatagcgggaacgc

SEQ ID NO: 55019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacggccgtaagtatcaggcctcatcgcc

SEQ ID NO: 55020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacgggcattagataatgtccttttgctc

SEQ ID NO: 55021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacggtccagtttaatatgccatgctgtg

SEQ ID NO: 55022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccactctgtagcccggtcgttacctgttgt

SEQ ID NO: 55023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccactctttagcgttttgctacgccacgcc

SEQ ID NO: 55024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccactggagactccaaccatatgcgtgaat

SEQ ID NO: 55025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccactggccggacgctttgcggtatcggag

SEQ ID NO: 55026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccactggttcagctcatgcagcacacggcc

SEQ ID NO: 55027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccacttgttttgctccgtcggcgtggattg

SEQ ID NO: 55028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagaacattattgtttgtggcaagctgct

SEQ ID NO: 55029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagaaggggggagtacggtgctagtcttt

SEQ ID NO: 55030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagacggttggtttactcgcagcgtctac

SEQ ID NO: 55031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagactagtgtaatctgttgtttttcgcg

SEQ ID NO: 55032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagagggaatcataacagagcggacttgg

SEQ ID NO: 55033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagatggtacgcaacgtttttcggctctc

SEQ ID NO: 55034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagccagtggatattaggcgggtacaggg

SEQ ID NO: 55035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagcccttgctcaagctagtgccccggtt

SEQ ID NO: 55036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagcggcatcccttctcgttccatccctg

SEQ ID NO: 55037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagcgtgtgaagaagcactttggatttgt

SEQ ID NO: 55038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagctaatcctcggagggctgtgaggatt

SEQ ID NO: 55039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagctggtgcaaaaaccctcacgtcgtga

SEQ ID NO: 55040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaggatagtgtcccggatcagtttgcctg

SEQ ID NO: 55041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaggatgtctgttcactagcttggtggcc

SEQ ID NO: 55042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaggcatgacgcgatcgagttgtacggtc

SEQ ID NO: 55043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaggcggtgaccgtccgggtcgcacgtac

SEQ ID NO: 55044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccaggctttaggtggattgagttatcataa

SEQ ID NO: 55045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagtaacgcgcagctcgtgggtattgagc

SEQ ID NO: 55046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagtggcagctcttgacattagggttctg

SEQ ID NO: 55047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagttaggtactgctctcgacgtttgcta

SEQ ID NO: 55048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagttatatagtccgtcgtcgttcacggg

SEQ ID NO: 55049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagttattccggtcccctatgctcaatgc

SEQ ID NO: 55050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagttctcccgattcaaggttgaaggtca

SEQ ID NO: 55051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccagtttggctgtgtaagggtttctggttc

SEQ ID NO: 55052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccatacttgtgcggacagcggcttcgtttc

SEQ ID NO: 55053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccatcacgctctatgccacctaaacctgcg

SEQ ID NO: 55054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccatccgcttttgctgtatactgggtgatg

SEQ ID NO: 55055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccatcggcaaaacttgtgatcgattttacc

SEQ ID NO: 55056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccatgcggggaaatcagttaatggggattt

SEQ ID NO: 55057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccatggttaaagtgatggttctgtggttat

SEQ ID NO: 55058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccatgttccgggtcaatttggcggcaccat

SEQ ID NO: 55059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccattaaggtggcctagcgtgtctgggtga

SEQ ID NO: 55060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccattcgtcgtaatctctattttcactagc

SEQ ID NO: 55061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccattgcacaaggcgagtcactcatcgggg

SEQ ID NO: 55062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccaacgcgccccgtaccgcgagtcagctt

SEQ ID NO: 55063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccaagataggtttacgtctcgccattagg

SEQ ID NO: 55064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccaagtacgtcatatcgaagacactgatg

SEQ ID NO: 55065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccagcggccttaatcctgttcccccttgc

SEQ ID NO: 55066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccagctcggtgggggctgtgggattctgt

SEQ ID NO: 55067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccaggtccgcggagggaagtggttgggtt

SEQ ID NO: 55068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccatgggcgcgctgttatctattcaaatg

SEQ ID NO: 55069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccatggggctggcgagaggtaccgtttac

SEQ ID NO: 55070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccccaacagatatacgtttaactggtcaga

SEQ ID NO: 55071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccccagctggctgatacgggtgaagggtac

SEQ ID NO: 55072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccccccggagggcagcaactctcccctact

SEQ ID NO: 55073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccccgagcaacgcggagagtggctatctg

SEQ ID NO: 55074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccccggtactcccctgctctcgacgtctt

SEQ ID NO: 55075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccccggctgacctcacgccctgaaggttct

SEQ ID NO: 55076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccccgtagtatgtttcgctacacgaatccc

SEQ ID NO: 55077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccctgaatattgatgggaacataagcgac

SEQ ID NO: 55078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccctggctaggaatttctttagttccgat

SEQ ID NO: 55079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccccttaccgatgcacaagcgagtccgggc

SEQ ID NO: 55080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgaactgtctaccagaccggacggggcg

SEQ ID NO: 55081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgacaggtctgacttaccaccgatgcgg

SEQ ID NO: 55082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgaccagctatgccgtccgaatttactt

SEQ ID NO: 55083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgacgggtgcttgcgtcgccccttgtag

SEQ ID NO: 55084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgactctatctcgtcctctagtcctgta

SEQ ID NO: 55085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgagcgtggtgcaacttagtaccgtcga

SEQ ID NO: 55086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgagggaggtgatcacgacgattctgct

SEQ ID NO: 55087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgagtattacccgtaggtattaagcttt

SEQ ID NO: 55088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgattgaatcgtgcgttcttcggcattg

SEQ ID NO: 55089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgcgataggtaccgaggcaggctggggt

SEQ ID NO: 55090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgctcttcgtctcgcttacaaagctact

SEQ ID NO: 55091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgcttggtctgagatttcgatgcaattt

SEQ ID NO: 55092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccggcgactgtcaacatagggaacggact

SEQ ID NO: 55093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccggggcgtttgcatattcccgctctcgt

SEQ ID NO: 55094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccggggttgatgcacattatcagtgcgaa

SEQ ID NO: 55095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgggtcggagtacatgcttgtcctaccc

SEQ ID NO: 55096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgggtggcattattttgctgaatcttcg

SEQ ID NO: 55097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccggtggtgctattcttttttcactcgca

SEQ ID NO: 55098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgttatggagataggatcacctagcaac

SEQ ID NO: 55099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccgttctcttgggtagttcgagcttctcg

SEQ ID NO: 55100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccctagcacgtatcacgaggaaaggttgcc

SEQ ID NO: 55101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccctcaggggtaaggcttgcgtttcgagat

SEQ ID NO: 55102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccctccgtagctttactttctttagacgcg

SEQ ID NO: 55103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccctcgcacgtacagtttggtggagcgatt

SEQ ID NO: 55104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccctcgcagtgaatggtgcggatctggtta

SEQ ID NO: 55105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccctcgttgtgctacccgtgaagtttacat

SEQ ID NO: 55106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccctctacttgtcacgtttggtaaggcctt

SEQ ID NO: 55107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccctgatgagcggcgttacttcggtcgggt

SEQ ID NO: 55108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccttacaaacgggcgtagcgtgtatatgt

SEQ ID NO: 55109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccttattgtgtggggaaaatgccacaccc

SEQ ID NO: 55110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccttccacgctgatttttttaggcacact

SEQ ID NO: 55111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccttcctcaaaggaacgtggcagggttcc

SEQ ID NO: 55112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcccttgccacttaacacgtctatcgcccgg

SEQ ID NO: 55113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgaaccttgccggcagtacacgaggaccg

SEQ ID NO: 55114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgaacgccagcttaaggccacgtgatacc

SEQ ID NO: 55115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgaagtcacgagctcggtgttgcggcgta

SEQ ID NO: 55116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgaagtggttaaggcgtccaacctcagtg

SEQ ID NO: 55117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgaatgggatggcacaattcctactggtg

SEQ ID NO: 55118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgaatggggatgggggccgccgtgtttgg

SEQ ID NO: 55119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgaatgtttacgatgtggctatagttata

SEQ ID NO: 55120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgacaacttcgccaacgcgcattcagggc

SEQ ID NO: 55121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgacaatcgttgtttttgaggtgcacgcc

SEQ ID NO: 55122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgacacacgcacggcgtcatacttatctt

SEQ ID NO: 55123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgacactggctactagtgtagcttctcga

SEQ ID NO: 55124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgacatacggcaatttgcaacacgggcgg

SEQ ID NO: 55125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgacccggctgtttatctagtctagactt

SEQ ID NO: 55126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgacggcattctcgttttatgtcatggga

SEQ ID NO: 55127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgactggagaaaagagtggggggccagga

SEQ ID NO: 55128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgacttatttacacgttgcaatggctctc

SEQ ID NO: 55129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgagacatggtagcccacgtttacacatc

SEQ ID NO: 55130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgagaccgaccagcagcgtggttccttca

SEQ ID NO: 55131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgagacttctggtttcgcaactagtgtgg

SEQ ID NO: 55132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgagccgttgtgagccaaccacaccgtct

SEQ ID NO: 55133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgagcgggatgggaccggtggtgctctca

SEQ ID NO: 55134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgagcggggaatgaaccgggctgctgttc

SEQ ID NO: 55135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgagctgtggttcggcgttcctaggaagt

SEQ ID NO: 55136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgagcttacctgcccattatgttctgcgg

SEQ ID NO: 55137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgagcttcactgtgagcgggactccgtcg

SEQ ID NO: 55138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgaggtcgcaccaccaccagtccctcatc

SEQ ID NO: 55139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgaggtgatagcgacgcagtgtttaccga

SEQ ID NO: 55140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgaggttaggaggtatggggccatggtcg

SEQ ID NO: 55141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgagtgctggttacaaggattttgcggcg

SEQ ID NO: 55142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgatcacgaggcagtatatcgctcacctc

SEQ ID NO: 55143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgatcagcctggtcatctcttacgattgc

SEQ ID NO: 55144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgatctgtctattatcttgtcactcaacg

SEQ ID NO: 55145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgatgaggtcaggggagacagggtcgggg

SEQ ID NO: 55146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgattagaagtctcacctctcttgccagc

SEQ ID NO: 55147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgattcatgtccctgcccagatttgtgaa

SEQ ID NO: 55148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgattccaactgggaacaaacatgtttag

SEQ ID NO: 55149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcactgggtagccactatgtttctggag

SEQ ID NO: 55150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcagagagatgatttagtacgcgatgcc

SEQ ID NO: 55151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcagcgatgtaccttggggggtatgtgt

SEQ ID NO: 55152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcaggcgtcttcttgggggattgggtga

SEQ ID NO: 55153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgccaacgtgcagcttgacgtctatacgc

SEQ ID NO: 55154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcccgcaataagacggagggcatttggg

SEQ ID NO: 55155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgccgcagggtgattagcgcgcgccgtgg

SEQ ID NO: 55156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgccgcggtttcatactcgctgtaatccc

SEQ ID NO: 55157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcctaatgttcggcaagcctgagtcgtc

SEQ ID NO: 55158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcctacaaaagtatcttgtcgcggtggt

SEQ ID NO: 55159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcctcacctgccgccagttcgggtatcg

SEQ ID NO: 55160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcgacggggatcttcataggttccgatc

SEQ ID NO: 55161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcgaggaaactcggcagcgagaacggta

SEQ ID NO: 55162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcgattgctgttctttcacatttaagat

SEQ ID NO: 55163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcgccgtattggtcatacccgttagagt

SEQ ID NO: 55164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcgcgcccaacctatgaagctacttgtg

SEQ ID NO: 55165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcgcgtgcaggaattaccttaggattgg

SEQ ID NO: 55166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcggaggcgttaagaatcggaatacttg

SEQ ID NO: 55167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcggcgttactggttatggtgcttccgc

SEQ ID NO: 55168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcgggctgtggtgatgacctcgcgcatt

SEQ ID NO: 55169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcggtacggggaaaccacatttacgggc

SEQ ID NO: 55170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgctacgtgaggcggtctttgacaaccgc

SEQ ID NO: 55171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgctcaccctgtcaggccggctggttgtt

SEQ ID NO: 55172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgctgacagtgtatacgacgcgtgagccg

SEQ ID NO: 55173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgctgcacggtttgcgttaatctcctttc

SEQ ID NO: 55174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgctggcaagagactcggtgtcaatgctg

SEQ ID NO: 55175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgctggccgacctgtggtactagtagccg

SEQ ID NO: 55176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgctgggggagggaggctaatagatccgg

SEQ ID NO: 55177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcttcgttaaatcgccctggctctgggg

SEQ ID NO: 55178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgcttttcagtgaacaggcggatattgcg

SEQ ID NO: 55179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggaaggtaaacagtgagtgcgtgggact

SEQ ID NO: 55180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggactccctgccccggtggttgggctgc

SEQ ID NO: 55181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggagagcgtgggtgagctcgaggctttt

SEQ ID NO: 55182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggagcacattcaactcctcgggtacgtg

SEQ ID NO: 55183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggagtcctagggcttgtaacgagggtta

SEQ ID NO: 55184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggatacgaattgagggcttccgtggtct

SEQ ID NO: 55185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggatctccctacggttgggcacggtagg

SEQ ID NO: 55186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggattagcgcggggatcagagggatatg

SEQ ID NO: 55187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggcacgatcgtaggaaattatatcggtc

SEQ ID NO: 55188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggcagtgggggtgtaaagagtggatgag

SEQ ID NO: 55189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggcccgtcttgacgtttggttctggaca

SEQ ID NO: 55190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggccgacgctaattcagcttaggtagca

SEQ ID NO: 55191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggcgaccattgctatgttacgggcggat

SEQ ID NO: 55192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggcgttttctgggttaggtagatccgac

SEQ ID NO: 55193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggctctgaagcaatacgcagcctaggct

SEQ ID NO: 55194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggagaaactgacccttcccctacctaa

SEQ ID NO: 55195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggccgtttcgatgtagatgacgtctaa

SEQ ID NO: 55196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggggacgctccctggtgataagcgttac

SEQ ID NO: 55197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggggggccggtaggtgtgccctcgtaga

SEQ ID NO: 55198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggggggtgccaggtctgcgagtctccgg

SEQ ID NO: 55199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggggttgctcaagcgtccaaataattc

SEQ ID NO: 55200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggggtgttctcgttctgttgccgtccgg

SEQ ID NO: 55201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggtactaagtccaactacctgcgccac

SEQ ID NO: 55202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggtcacatgccaaatatccgctatcgt

SEQ ID NO: 55203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggtctagtgggctatcacagagaggta

SEQ ID NO: 55204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggtgaaaccgccgcacatgcttactcg

SEQ ID NO: 55205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggtgctgttttagcatcgctaccgcgc

SEQ ID NO: 55206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggtggtgtggttgtttcccggtcacac

SEQ ID NO: 55207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggtggtttcagaattaaactttcacaa

SEQ ID NO: 55208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggtgtcctccttggatctcgtcatgac

SEQ ID NO: 55209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgggttagttttggcaatagcgggtggcg

SEQ ID NO: 55210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggtaaatgcgcgatcctgtgacttgtcg

SEQ ID NO: 55211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggtacacgtggcttgtctggcgactggc

SEQ ID NO: 55212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggtgtgattcgataacgcacattgaacc

SEQ ID NO: 55213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggttacttccgaactgcgccgggggtct

SEQ ID NO: 55214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccggtttagtggatacgacgtatcgcagcc

SEQ ID NO: 55215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtagaatcgtgtagttatttgacgatta

SEQ ID NO: 55216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtatcacccctgctacagaaagccggtc

SEQ ID NO: 55217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtatccgtttcgaaatcttccgggttgt

SEQ ID NO: 55218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtatgttgagctgcggggacgggccgcg

SEQ ID NO: 55219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtcaaagtgagtatgtgctgcgacgagc

SEQ ID NO: 55220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtcagtcagagttctcaatccttggggt

SEQ ID NO: 55221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtcatccagtacaatccgcacagtgttg

SEQ ID NO: 55222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtcatcgcctatcgctcgcatcttctgt

SEQ ID NO: 55223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtcatgcaagtttctttcccgttatgga

SEQ ID NO: 55224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtccaagaacagcccgattaacgctcta

SEQ ID NO: 55225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtcggcaaattgacctcgtggggcttgg

SEQ ID NO: 55226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtctatacgtcatcggcttgctgattta

SEQ ID NO: 55227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtctttcagcgggggtgtcatacttttt

SEQ ID NO: 55228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtgcacttgacgtatagcttggattctc

SEQ ID NO: 55229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtgccatcctgaacgcttgcagcaaccg

SEQ ID NO: 55230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtgggtgccacagttttaacgatggtct

SEQ ID NO: 55231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtgtaccacgcagtactagcgtaagttc

SEQ ID NO: 55232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtgtcccgggtggtcgatgtgagacgag

SEQ ID NO: 55233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgttattcacgtggtttgcttcgtcagtt

SEQ ID NO: 55234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgttcattcgggtgcgctcgctgtggctg

SEQ ID NO: 55235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgttgaaagtcggggctagttgtggcaga

SEQ ID NO: 55236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgttgaacggtcatgcacgtgtttaaccc

SEQ ID NO: 55237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgttgatagccgcatagactggtcactga

SEQ ID NO: 55238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgttgccacatcccgtgatttgggctcct

SEQ ID NO: 55239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgttgggttgcgcgttacacttccgcctg

SEQ ID NO: 55240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccgtttccagctcgtgcttttgtttactaa

SEQ ID NO: 55241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctaaaacgggcagttctcggcacgcacac

SEQ ID NO: 55242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctaaagagatgaattgctcaatgtgtgtg

SEQ ID NO: 55243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctaaaggctcaaccaaatgtatgtgtctc

SEQ ID NO: 55244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctacatacataaggattggcgtgtgctgg

SEQ ID NO: 55245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctacccctcattcctctacactgccttgc

SEQ ID NO: 55246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctactcgatgatctcggtaatccacttcc

SEQ ID NO: 55247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctagcgcttttaaagagaggattccagcg

SEQ ID NO: 55248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctatcccataattgcggtctatgttcctg

SEQ ID NO: 55249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctcaagcgctttcagcatgtacctatcgc

SEQ ID NO: 55250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctcacagtggctctcggtttggtcctatt

SEQ ID NO: 55251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctccaatttgccatactgactatagttct

SEQ ID NO: 55252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctcccgttgtacagagaatttggtcaagt

SEQ ID NO: 55253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctccgagagggattttgcgtgccgctacg

SEQ ID NO: 55254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctcgcaatggtagaagttggatctccctg

SEQ ID NO: 55255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctcggcagtgtctctttggggccagcgtg

SEQ ID NO: 55256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctcgggccatgctgtggttcggtccgatt

SEQ ID NO: 55257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctcgtacgcctcgttctgtcctgctccat

SEQ ID NO: 55258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctctaggtcggtggaggtcggtggtcttg

SEQ ID NO: 55259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctctcttgtatctggctcctcgttacatg

SEQ ID NO: 55260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgaagtgctctctatatgatcgactccc

SEQ ID NO: 55261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgagtagagtgcagaaccggccatcccg

SEQ ID NO: 55262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgataacacgttcgccccttgacgtttg

SEQ ID NO: 55263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgcacatttattgctgagaaccttcttg

SEQ ID NO: 55264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgcatcgagcggtaagctatctagtgca

SEQ ID NO: 55265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgcatgagttatatgtcggtatactttg

SEQ ID NO: 55266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgcatggttggagcgaacgaaaacaggg

SEQ ID NO: 55267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgcgagccccttgctgggatttacctgc

SEQ ID NO: 55268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgcgccatcccacctctctaggacaccg

SEQ ID NO: 55269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgcgggggtcgggcgaagcgttaagatt

SEQ ID NO: 55270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgcgttcgtgtatcgcggtatctcgggt

SEQ ID NO: 55271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctggcagttgtacgtgcttaccgactggt

SEQ ID NO: 55272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctggcgacattcttggccaacaggtcgga

SEQ ID NO: 55273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctggctagttcctgaacaacgatcttgct

SEQ ID NO: 55274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgggctagtctcttatgatcggtgcagc

SEQ ID NO: 55275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgggtgtgttgcgttgtgccttctctga

SEQ ID NO: 55276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctggtaccggcgcaagggtggctccgaca

SEQ ID NO: 55277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctggtaggacggtgtgtcatgtcctcgac

SEQ ID NO: 55278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgtcgaggtccggaggttgaccagggca

SEQ ID NO: 55279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgtggcaacagggtctgaactgttcggg

SEQ ID NO: 55280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctgtggtgagccgaacactttggcgcgtg

SEQ ID NO: 55281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccttacgtgggaacggaggtggttgcgtca

SEQ ID NO: 55282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccttcatagctcgcgtgcaaggtttgtttc

SEQ ID NO: 55283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccttcatttcctttttctcgaatgcaaagt

SEQ ID NO: 55284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccttccgtaacattaataagcgtcacgccg

SEQ ID NO: 55285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccttgcggcagtagattgtacttggcctcc

SEQ ID NO: 55286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctttatatgagttgggtagtgttggaaac

SEQ ID NO: 55287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcctttggtgctttccgtatctcatggtgga

SEQ ID NO: 55288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccttttactgcctttgtaagagtattattg

SEQ ID NO: 55289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtccttttctcagtaggcatcgtgtggaatta

SEQ ID NO: 55290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaaaaacctgtggacaccgtaacttttta

SEQ ID NO: 55291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaaaccatggaactgtacttaagtgctgg

SEQ ID NO: 55292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaaacctgctacaatcgcgatcaccttta

SEQ ID NO: 55293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaaacgcctaatctgtatggggaacgtgg

SEQ ID NO: 55294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaaatggattggcggggctaactggactt

SEQ ID NO: 55295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaacaacagggagcgcgacgagcaccgtg

SEQ ID NO: 55296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaacacacgtcttgtgtattggtaagagg

SEQ ID NO: 55297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaaccccacccaatctgcggaggcgcttg

SEQ ID NO: 55298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaacggaatagccgtgtgagggttcaagt

SEQ ID NO: 55299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaactcgactccgcctttccggcactcgg

SEQ ID NO: 55300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaagcggaaagtattatgcgttgcgaatg

SEQ ID NO: 55301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaagcggggggccgtcactctgcatgctt

SEQ ID NO: 55302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaagctctctcgtgatcgggatgggcgcg

SEQ ID NO: 55303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaagcttatgacgtggagatataaagttc

SEQ ID NO: 55304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaaggggttcgcgaaatagacgtatcaag

SEQ ID NO: 55305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaagttacccctgctcgtgcatttaccgt

SEQ ID NO: 55306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaatgtccgttctcccaattatttaggag

SEQ ID NO: 55307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaattatgatgaaactcgggggactgcgc

SEQ ID NO: 55308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaattcgtgctcggtgctcccttggcagc

SEQ ID NO: 55309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacaactaattgtgcctgcccttgacttt

SEQ ID NO: 55310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacagttatacgtggcgaggtcatcgcgg

SEQ ID NO: 55311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacatcatttggagtagtgctgttactcg

SEQ ID NO: 55312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaccaatgaatggtatggtgtcatcctcg

SEQ ID NO: 55313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaccacccggggactgagggtgaaagcac

SEQ ID NO: 55314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaccctgctgatgtttatcgccctacgct

SEQ ID NO: 55315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaccgcaataagccaattgctcgccgtga

SEQ ID NO: 55316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaccgcaggttgacttggaagtggtatgg

SEQ ID NO: 55317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaccgtgcaaccatttcgtgcggcggtcg

SEQ ID NO: 55318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaccgttaatatacgcttttcgccgctct

SEQ ID NO: 55319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacctcctggtctaagcgtcccaataatc

SEQ ID NO: 55320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacgaaaccgctagccatgtccaggttcg

SEQ ID NO: 55321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacgaccatgcagcggagtaacgcctgcg

SEQ ID NO: 55322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacgagagtccttctgggacccgctttag

SEQ ID NO: 55323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacgattgaacaaccggtagccctatgaa

SEQ ID NO: 55324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacgcctgaaagtctacttacctcagctt

SEQ ID NO: 55325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacgggcctattcctggcagttcctggct

SEQ ID NO: 55326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacggtgcgaagcgacagggttggtcccg

SEQ ID NO: 55327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacggttcgagcggacgggtgtaattggc

SEQ ID NO: 55328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacgtaatgtacttaactgccggaactgc

SEQ ID NO: 55329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacgtgttgaggctgcaatccctcactcg

SEQ ID NO: 55330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgactcaaaagcccggtcgtttcggcgggg

SEQ ID NO: 55331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgactcggaagatttgatttgtagattcct

SEQ ID NO: 55332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgacttcgccggcccatacgtaccgttatc

SEQ ID NO: 55333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagaaaaaattgttcccgccagtcggcga

SEQ ID NO: 55334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagaacagcacgaagctcgttgatcacgt

SEQ ID NO: 55335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagacagaggtcgctatacgtcgcccggg

SEQ ID NO: 55336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagatgcgcaccccaggagtacgacgaat

SEQ ID NO: 55337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagcaattcgaaacggactatcccaggct

SEQ ID NO: 55338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagcaggacacggccgccggaagctcggg

SEQ ID NO: 55339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagcataagtccacaagacgtgccaatgt

SEQ ID NO: 55340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagccaaggatacgtgcgttgtatatgtg

SEQ ID NO: 55341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagccggtcacatcatggttatctgcgcg

SEQ ID NO: 55342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagcgaggcggttggattgaacactcccg

SEQ ID NO: 55343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagcgtacgatggccatgtaagctgtgtt

SEQ ID NO: 55344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagcgttcaggacggctggtttcgcggta

SEQ ID NO: 55345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagctaaagttttgtgtaaccgcaaaagg

SEQ ID NO: 55346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagctctaagtactattagggtgcaggac

SEQ ID NO: 55347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagcttacataccagggtcctttcgcact

SEQ ID NO: 55348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaggatagggaattacgattgcgggattg

SEQ ID NO: 55349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagggttctagggttgagtactctcgcga

SEQ ID NO: 55350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgaggtagataagtcggcacttctggtgag

SEQ ID NO: 55351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagtacattaccacgtgagggcggtcgct

SEQ ID NO: 55352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagtgcggcgttagttatggttttgggga

SEQ ID NO: 55353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgagtggtgcaactacacccattacggatg

SEQ ID NO: 55354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgataatcgcgtacagcatgtttgcccggt

SEQ ID NO: 55355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgatactgatgcccgctaacgtgtaacagt

SEQ ID NO: 55356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgatagagctccatgtgcagccgttgacgg

SEQ ID NO: 55357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgatccatggaatgcacaaagtatctgcga

SEQ ID NO: 55358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgatcctgaagctgctggcatcgctgtgta

SEQ ID NO: 55359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgatgacaaagccctacaaacactgcactg

SEQ ID NO: 55360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgatgcaatatccggcgtattccgcctgct

SEQ ID NO: 55361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgatgggagggcgccgtcgatatccgaatt

SEQ ID NO: 55362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgatgttaatatacttaagagcacacactt

SEQ ID NO: 55363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgatgttgacgcttcggcggcttggcacgt

SEQ ID NO: 55364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgattatttcttgtttatttcgtttaaggc

SEQ ID NO: 55365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgatttgggcagggcatcgtcaaccgttgg

SEQ ID NO: 55366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcaaaacggtttgagtcaactgctgcctg

SEQ ID NO: 55367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcaagccgggtcctcccgttcctgtcatt

SEQ ID NO: 55368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcaagccgtggcgagcctggtacgctcct

SEQ ID NO: 55369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcaaggcattgaactaatacggactttaa

SEQ ID NO: 55370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcaaggcttgtatggagggtcgcgggtta

SEQ ID NO: 55371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcaatacgaagccatgggggggcatcctt

SEQ ID NO: 55372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcaatgataagttccgataccggtgcgcg

SEQ ID NO: 55373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcacaacggcttacagcgcccacattggg

SEQ ID NO: 55374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcacacatttcccaagcccgcacggtctt

SEQ ID NO: 55375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcacccatgaggcagcattaggcctcggc

SEQ ID NO: 55376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcaccggaggatgtcgatgtgaggggagt

SEQ ID NO: 55377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcaccttgtcgtcctggctttaaacctgt

SEQ ID NO: 55378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcacgcagggggagtctgcaatcgcgccc

SEQ ID NO: 55379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcactcagtgcagtgttagctaatgtttg

SEQ ID NO: 55380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcactcgtcactgaataccttttatcagg

SEQ ID NO: 55381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcagaaagtgcaattgtaattctccggta

SEQ ID NO: 55382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcagcagcccgtaatggattgttagttga

SEQ ID NO: 55383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcaggcggctctggaatgtagtgctggct

SEQ ID NO: 55384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcagggacttagctgactggagtgaagcc

SEQ ID NO: 55385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcagtaaccggatttttttgtgtcgaccg

SEQ ID NO: 55386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcagtatgtgagaacgagggcttgtgctt

SEQ ID NO: 55387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcatagaggcgcggtctttgaggtgcttc

SEQ ID NO: 55388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcatcattctaggtctatagacgcggcgc

SEQ ID NO: 55389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcatgcggaacgcgaatcaggatattgcc

SEQ ID NO: 55390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcatgtaagaactgaagtttatggcatcg

SEQ ID NO: 55391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccaaaggtcgtgttcgtatgcttgtgtg

SEQ ID NO: 55392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccaaccaacgggctgtctcatgcagttt

SEQ ID NO: 55393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccacactgtcatttgcgagaaccacccg

SEQ ID NO: 55394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccacccagtttacagccaatcatcaggt

SEQ ID NO: 55395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccacgtcgtttcttatgcgcgccatttt

SEQ ID NO: 55396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccatgaagctgcctcccgacgcaagcgg

SEQ ID NO: 55397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccattggttcacttgttcacctcgactt

SEQ ID NO: 55398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcccaacttcgctctgggcccagcgttca

SEQ ID NO: 55399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcccagcttttagtcccgggtcgcggact

SEQ ID NO: 55400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcccgcggtccggccggttaaagacgttt

SEQ ID NO: 55401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcccggaatcggacccagtagttagggta

SEQ ID NO: 55402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccctatcaatatacacacatttgctgtc

SEQ ID NO: 55403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccgatcacaggtttacgggtatgtccgg

SEQ ID NO: 55404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccgcaggaagcttccaagatggtctaac

SEQ ID NO: 55405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccgcgtctcagtatggtgcgggtgtagt

SEQ ID NO: 55406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccgctcctaacaactcctttgtgaaatg

SEQ ID NO: 55407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccggtaagagctggcggtaattcgctgt

SEQ ID NO: 55408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccggtacgccaagctaatcgttgggttc

SEQ ID NO: 55409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccggtgccctcattttatgggtatccca

SEQ ID NO: 55410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccgtggtgatgccatagacttataggca

SEQ ID NO: 55411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgccgtttcatgagggagtactatgtgtcg

SEQ ID NO: 55412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcctggcagcaagcctcagtacgatctcg

SEQ ID NO: 55413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgaaagatggagccgtcggtgggcttgt

SEQ ID NO: 55414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgaagtcgttcaaagggggactactgtg

SEQ ID NO: 55415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgaatctagaggctgccggaattttttg

SEQ ID NO: 55416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgaccagcagtggatgtgataggctggc

SEQ ID NO: 55417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgacgggtaagtgcttatctaaggaagc

SEQ ID NO: 55418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgagcccaattgcgctgtaacattgttt

SEQ ID NO: 55419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgaggtaactgggggttcttagctcgtc

SEQ ID NO: 55420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgatgcacggtgttggctctacgcctgg

SEQ ID NO: 55421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgatgccgcaggacacgaaatggggtac

SEQ ID NO: 55422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgatttaacctcgttcactgaacctggt

SEQ ID NO: 55423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgcagaacaacgtcgctgttgcgcaacg

SEQ ID NO: 55424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgccaagagtcacaggaggtgatgtttc

SEQ ID NO: 55425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgcgcggaaggtctgggaatgtcacagc

SEQ ID NO: 55426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgcggagtgccatgggctcgagatcgtc

SEQ ID NO: 55427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgcggttccatcgctccttccggatttg

SEQ ID NO: 55428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgcgtcgggatcaaactgtgggccgcgg

SEQ ID NO: 55429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgctacgagggtattatgtgcgtgaatc

SEQ ID NO: 55430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgctgtaataccaaggtccgtaactttt

SEQ ID NO: 55431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcggaggcacggcggtttcgagttcacgt

SEQ ID NO: 55432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcggcaagcacccaaggcagagattcaat

SEQ ID NO: 55433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcggcacgcagtctgaatcgggacccccg

SEQ ID NO: 55434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcggccggggaacatccggtttcgcgtgc

SEQ ID NO: 55435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcggccgggttgccttcttgatgtcgtag

SEQ ID NO: 55436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcggcctgcctaaaccatctgcgctagag

SEQ ID NO: 55437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcggcgacgtagagttccgagctaacgtg

SEQ ID NO: 55438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcggcgtgggaggggtcacggtacgtttg

SEQ ID NO: 55439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgggccatggcacgaacgactatcggca

SEQ ID NO: 55440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcggggagtgaccgttgacccttacccac

SEQ ID NO: 55441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgggggaacgggtggttgtaccggctgc

SEQ ID NO: 55442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgggggtctttgcatagtgcccacgtat

SEQ ID NO: 55443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgggtgtggattccagcacttcagtacc

SEQ ID NO: 55444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcggtccaagtggttaggcacagtccggg

SEQ ID NO: 55445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcggtcgcgtgtattgacgtttcgtgggg

SEQ ID NO: 55446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgtaaccttgcccggggtaccatagaaa

SEQ ID NO: 55447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgtaggttagtttattgacaccggaaag

SEQ ID NO: 55448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgtcaaagtatggtctttggaactagga

SEQ ID NO: 55449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgtcgaatagcgtcagcatagctgaggg

SEQ ID NO: 55450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcgttttcccccggtcctgctggagtagg

SEQ ID NO: 55451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctaaacaaaccatcgatgttcggtcgcg

SEQ ID NO: 55452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctaattgcataggatgacctgtaaggtg

SEQ ID NO: 55453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctacaagcatctgatagtgtccaaatac

SEQ ID NO: 55454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctagttaaaaggtaggccgcagatcttc

SEQ ID NO: 55455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctcagggtgataaactcaagggcaccgt

SEQ ID NO: 55456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctccttgcacagtagatccgcgtctcga

SEQ ID NO: 55457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctcgcgatgcttatctaagtgggatcgg

SEQ ID NO: 55458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctctgtgacgacttggtctgcctctcgt

SEQ ID NO: 55459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctcttagtccttgttgctccgtggcttc

SEQ ID NO: 55460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctgcaaggaatagggtagttggggcgca

SEQ ID NO: 55461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctgcgatggaaacgctaataagtctggg

SEQ ID NO: 55462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctgcgcacccagccctgtgcggacggga

SEQ ID NO: 55463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctgtggactccttaggcggctgcatcca

SEQ ID NO: 55464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgctgttggggttgtggtggttttttttgc

SEQ ID NO: 55465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcttaaccggaagttcgagagtaaacaaa

SEQ ID NO: 55466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcttaatcgagagatacttcgactgctac

SEQ ID NO: 55467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcttaggagaatccactttgtttaggcgt

SEQ ID NO: 55468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcttaggttgggttgggagttgttggatt

SEQ ID NO: 55469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcttcggtggcaatgacatagggtgcgtc

SEQ ID NO: 55470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcttgctcgcattcatcccggcgtttata

SEQ ID NO: 55471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcttgctgagggtctaagcgcgacgaccg

SEQ ID NO: 55472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcttggacatgtgtgtaagattggatcgc

SEQ ID NO: 55473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcttggtggccgaattggcgcagcatcgg

SEQ ID NO: 55474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcttttatcttgtagtccttgaattacct

SEQ ID NO: 55475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgcttttgcgcagccgggggtatttcgtat

SEQ ID NO: 55476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggaaagcgagggcccggttaccaaagcgg

SEQ ID NO: 55477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggaactatgtctttccctcggtattagcc

SEQ ID NO: 55478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggaagcggacgggtagacttgctgtttag

SEQ ID NO: 55479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggaaggctgggagatggtctgactcggtt

SEQ ID NO: 55480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggaatatgcggcttcctgggtggtgtgct

SEQ ID NO: 55481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggacagccgtttttacgggagtggtaccg

SEQ ID NO: 55482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggacatgaggacggtgacgcgccatctgt

SEQ ID NO: 55483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggaccacgggtaggttgacgtggagctgc

SEQ ID NO: 55484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggacgagggactcgttttgcacagaagtg

SEQ ID NO: 55485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggacgaggggtagctgtatgctaggtgct

SEQ ID NO: 55486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggacgctcccgtgtacagctgggcgtgtt

SEQ ID NO: 55487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggacgctggtaactaacttctgttttagc

SEQ ID NO: 55488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggacggtgcgccagtaatgttcgggcttg

SEQ ID NO: 55489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggacgtgtcctttgatacgctttcagtta

SEQ ID NO: 55490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggagacggagttcattcgtttgagctgta

SEQ ID NO: 55491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggagatggccttatctacagcgactttcc

SEQ ID NO: 55492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggagggaatcagtgggaacgtggcaatcg

SEQ ID NO: 55493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggagggccgcaacaacgatatagcgtgca

SEQ ID NO: 55494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggaggtggggggttttttcctgttgtgga

SEQ ID NO: 55495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggagtaagtcgtacagcgtggtcgtgtag

SEQ ID NO: 55496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggagtacgtcatgatcctcgggctcaggg

SEQ ID NO: 55497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggagtcgctttgttatgtgcaataggatt

SEQ ID NO: 55498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggagtggtaatcgtcacaagggtaatctt

SEQ ID NO: 55499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggatccactcgcggatgtgccggaacact

SEQ ID NO: 55500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggatcgtctcggccgtcacaccccgtgta

SEQ ID NO: 55501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggattttatgctgggggtatcgggcgctc

SEQ ID NO: 55502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcacaccatatgttgaatggatgtaacc

SEQ ID NO: 55503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcactgtccagacggcaggagtcttttc

SEQ ID NO: 55504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcagggtcgcgcagaacacgctggactt

SEQ ID NO: 55505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcatgaggtgaatgtatcggtcctcggt

SEQ ID NO: 55506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcatgatccgtcctgtatttgcttccgc

SEQ ID NO: 55507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcattaacccactcgcaacgtcgtagcg

SEQ ID NO: 55508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcattctccatgcagcagtaccgagggt

SEQ ID NO: 55509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggccactcaggttacttttccggacaccc

SEQ ID NO: 55510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggccgagtgcaacggtgccatgttcatgc

SEQ ID NO: 55511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggccgcgtcttaagcccatccggtacgct

SEQ ID NO: 55512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcctcactgtggcgtaccttgcgttgca

SEQ ID NO: 55513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcctggacatgtattttattccacgcgg

SEQ ID NO: 55514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcgactagcgggttttgctcgcacaccg

SEQ ID NO: 55515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcggccgtctgttttagtatgctgattt

SEQ ID NO: 55516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcggcttaaagtagttcatggtgtctgt

SEQ ID NO: 55517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcggcttcagcttattagcgtcaggttg

SEQ ID NO: 55518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcggggaatcatgcaaagcagtcccgcg

SEQ ID NO: 55519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcggggtctcgaggatctcacgcagtaa

SEQ ID NO: 55520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcggtatcgaattggtgatgtgatttaa

SEQ ID NO: 55521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcggtgacattacccagggaacgacttg

SEQ ID NO: 55522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcgtactagatatccggctccgtaccgt

SEQ ID NO: 55523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcgtggtatggtgggactgcgaggaagg

SEQ ID NO: 55524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggcgtgtacgtgagcccgcggacattgct

SEQ ID NO: 55525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggctaatcgaaactcgttgcgtcgtacgc

SEQ ID NO: 55526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggctaggttcgtttcccgatggacggtgg

SEQ ID NO: 55527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggctcatcaattacaacgggctcacgtga

SEQ ID NO: 55528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggctctaggtctggattttactgtagagc

SEQ ID NO: 55529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggctcttcgacatcacggtggattatgcg

SEQ ID NO: 55530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggctctttgcagcgtggtcacgggcgggg

SEQ ID NO: 55531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggctgagggattttcacgatatacggcgt

SEQ ID NO: 55532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggctgctagtaatccggcatggcaacgtt

SEQ ID NO: 55533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggctgtcggtagaggagagtgagcgtatc

SEQ ID NO: 55534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggacctctcacggacatggatacgtggg

SEQ ID NO: 55535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggagcgcactggactgcctttcgttgcg

SEQ ID NO: 55536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggaggcggtttttccatggactggctta

SEQ ID NO: 55537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggagggacacgtccgctcgtgttgggag

SEQ ID NO: 55538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggagggttgcaggattcgttagtgtttg

SEQ ID NO: 55539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggcacattgctcacaatttgtggtgcat

SEQ ID NO: 55540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggcatgagtataatgagaagggtcgacc

SEQ ID NO: 55541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggccagaagaagacatatagccagggtg

SEQ ID NO: 55542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggccttgaagggcaaaccagaaccacga

SEQ ID NO: 55543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggcgaatactgttccttcttcgttggtc

SEQ ID NO: 55544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggcgatggctccagcctttccaagttgg

SEQ ID NO: 55545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggcgcacggatcattggccagggagtgc

SEQ ID NO: 55546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggcggtggcttcgatgcgcttcccgcga

SEQ ID NO: 55547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggcgtggacccactatgcgtatgcgtgt

SEQ ID NO: 55548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggaagggcctggattagtgaagcaatg

SEQ ID NO: 55549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggaaggtgatgttctgctgtaattgaa

SEQ ID NO: 55550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggaccgcatgacctgacgtttaaggtt

SEQ ID NO: 55551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggaccgtgatgctgttccacgaatctc

SEQ ID NO: 55552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggagacggtagcccgcgcgtccctccg

SEQ ID NO: 55553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggccctgaagaatctaggaagacggtc

SEQ ID NO: 55554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggccctgtgatggtctactccttgctg

SEQ ID NO: 55555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggccgtagcgcgcgggggcatgtcacg

SEQ ID NO: 55556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggcgtgttgaaacatgcgacttcaatt

SEQ ID NO: 55557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggctcgaggtgggctagttcaaccgac

SEQ ID NO: 55558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggctgtcccttgactactgcctcgcgt

SEQ ID NO: 55559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggggaaataggcgtcaatcgtatctccg

SEQ ID NO: 55560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggggacggtaggggggctagtctggtta

SEQ ID NO: 55561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggggccaagctgacgcacagttggtggg

SEQ ID NO: 55562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggggcgggattggcgggtgtacgtcatt

SEQ ID NO: 55563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggggcaaatatatgcggtgattcctgg

SEQ ID NO: 55564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggggttttcgtgttcgacactttttgggg

SEQ ID NO: 55565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggtacagagtatcgacggtacgttctgg

SEQ ID NO: 55566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggtagtgctagagtatgcggcatatacc

SEQ ID NO: 55567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggtattactatggcgccggtaggaagtg

SEQ ID NO: 55568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggtccattgtggtcatcgagtgcacgtg

SEQ ID NO: 55569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggtccgttcgagctacagtttgtccctg

SEQ ID NO: 55570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggtcctatggctcacgcgctccgatggg

SEQ ID NO: 55571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggtgtaaacggggtcttggcagtatcca

SEQ ID NO: 55572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgggttgcgttgttacaaccagttccgctg

SEQ ID NO: 55573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtaagtgtggttcggctcaccttgctca

SEQ ID NO: 55574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtagatcctgccgccgcgccctgtcgtg

SEQ ID NO: 55575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtcaatcgggaatcgagccatgtacgcg

SEQ ID NO: 55576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtcacaaattcagccgcccttgtatgaa

SEQ ID NO: 55577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtcaggggggccattgcgagcgaaccta

SEQ ID NO: 55578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtcattatgggtatttgggtgggttaga

SEQ ID NO: 55579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtccaggccgtagcatatgctggagatc

SEQ ID NO: 55580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtcgagagtgctcttcgtttcccgagcg

SEQ ID NO: 55581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtctcgtgcgttgcaatggcatcctttt

SEQ ID NO: 55582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtgaaagtgcagggctgcagatcggcgc

SEQ ID NO: 55583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtggattcatcgggtgagcttatccgtt

SEQ ID NO: 55584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtggccagaccgttctagtaaagcaggg

SEQ ID NO: 55585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtgtaccactggctattagagctagctg

SEQ ID NO: 55586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtgtccgccgagttcagggtgctgtgct

SEQ ID NO: 55587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtgttgtcccctcggtcttcactgcgtg

SEQ ID NO: 55588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggttaatgggatactcggacgagggcgac

SEQ ID NO: 55589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggttacttatgcgttgacactggggcact

SEQ ID NO: 55590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggttctttttaaattttacatgctcgtaa

SEQ ID NO: 55591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggttgcggcttccagttaggttgcatccg

SEQ ID NO: 55592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggttggagagtgatccatcagtcgctcct

SEQ ID NO: 55593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcggtttagcccgggttcatgttagagcaaa

SEQ ID NO: 55594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtaaatatataacgatcagataatgtgga

SEQ ID NO: 55595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtaaccacgcccctcgccgctgccaggct

SEQ ID NO: 55596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtaacgtggtgctggtttagattcgttca

SEQ ID NO: 55597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtaagcggcacacgagggtgatgcgggat

SEQ ID NO: 55598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtacctaggtcttgttcaagcgcacgatt

SEQ ID NO: 55599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtacctggttaggcctcatatgcgggcgt

SEQ ID NO: 55600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtacgttaaccgtgcttttcgcctgcagc

SEQ ID NO: 55601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtaggcctgcgtacaagacgatcgttcca

SEQ ID NO: 55602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtagggtcgtgatccgttactcgaggttc

SEQ ID NO: 55603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtagtgctacaactagcttggttttgcgc

SEQ ID NO: 55604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtagtgtttgggggtcctggatggagtgg

SEQ ID NO: 55605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtagttaaaatcagctagggttccttttc

SEQ ID NO: 55606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtatactgcttaaggtgactcgatatagg

SEQ ID NO: 55607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtatttgggaggcggcttgatctcctctt

SEQ ID NO: 55608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtcaggttcgagggacattaccggcagga

SEQ ID NO: 55609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtcatatccggactcgctgtgggcatctc

SEQ ID NO: 55610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtccctacagctcgtggtcctagaaactt

SEQ ID NO: 55611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtcctgctccacgagctctcgacacgttc

SEQ ID NO: 55612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtcctggccgtgtatcctatatactcgtc

SEQ ID NO: 55613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtcgaaccgtctcgaccgatgctcagctg

SEQ ID NO: 55614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtcgagcgtgactccatgctttgctctcg

SEQ ID NO: 55615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtcgaggtgtatccttgagagcggcacct

SEQ ID NO: 55616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtcgctggaccctccctgcccgtgcgttt

SEQ ID NO: 55617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtcggatgtgctggcctctgtgataagtg

SEQ ID NO: 55618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtcgggtttgggtatgcgaggctgttagc

SEQ ID NO: 55619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtctagatattcggggattgctagtgggt

SEQ ID NO: 55620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtctggcggtttacgggcgaggcagtgat

SEQ ID NO: 55621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtctgtcgtacgccgcacctttttcatcg

SEQ ID NO: 55622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgatcgatgtggatgggtgaggtaggct

SEQ ID NO: 55623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgattaagaccttcagtattccatctcg

SEQ ID NO: 55624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgcagtcgctttatgttggcgtgtcggg

SEQ ID NO: 55625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgcatagagcacagccagttttacggtt

SEQ ID NO: 55626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgcatcacaattcattgcggtcgcctat

SEQ ID NO: 55627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgccgattcttacactacgataatgttt

SEQ ID NO: 55628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgcgacggactagagtggacgtgtgtgg

SEQ ID NO: 55629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgcgcaactctacttacctttcttttcg

SEQ ID NO: 55630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgcgtctccgtcctctcttattcacgtg

SEQ ID NO: 55631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgctacacgtggcgcccgtcatcaaagc

SEQ ID NO: 55632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgctacgggttttctttcatcgcgcatt

SEQ ID NO: 55633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgctaggcgggtcccagagttgctgggc

SEQ ID NO: 55634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgctcatcgatgtacgggcatgtgtcct

SEQ ID NO: 55635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgctgaatcgcggggtggagcgcacgca

SEQ ID NO: 55636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgcttgccgccgtcgtcttctgctggtt

SEQ ID NO: 55637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtggacgtagccggaagccacgccaagcg

SEQ ID NO: 55638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtggaggggcggggttagccgatagttac

SEQ ID NO: 55639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtggagttaccccactcgctttgttgcaa

SEQ ID NO: 55640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtggagttgcacactggatggttctacgg

SEQ ID NO: 55641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtggctctccacctgtaggagtgagcccg

SEQ ID NO: 55642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgggtttcgggacccttcctcaagtttg

SEQ ID NO: 55643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgtaactcgtatacagtcctctgctttc

SEQ ID NO: 55644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgtacagcagctaagtcccgaggcctgg

SEQ ID NO: 55645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgtagtgtggggcgacgctttcgtttgc

SEQ ID NO: 55646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgtatgggagacgctacctgacaggctg

SEQ ID NO: 55647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgtctcagagtgcaactacctgggacaa

SEQ ID NO: 55648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgtgagaagcaatgtccaaatggcgccg

SEQ ID NO: 55649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgtgatgggctatagcactctgtgagtc

SEQ ID NO: 55650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgtgcctgagcagcttcctccgattggc

SEQ ID NO: 55651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtgttgccggtgctcgcccgtggcttcgt

SEQ ID NO: 55652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgttacgagattaggtcgagtgactattag

SEQ ID NO: 55653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgttatgctacagatatggccgggactcgg

SEQ ID NO: 55654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgttcgggttaagaccgtgtacgcccgtcg

SEQ ID NO: 55655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgttgagcgggtcgaagtcccaatgtttcg

SEQ ID NO: 55656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgttgatcggtgggtgacggctgctcgatc

SEQ ID NO: 55657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgttgcacgtatgttagggcccaagccgtt

SEQ ID NO: 55658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgttgctgtcacgtcggtggggacacggtg

SEQ ID NO: 55659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgttggcactggtccgctctccactccgcc

SEQ ID NO: 55660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtttacgttgtagccagacaaagttttcg

SEQ ID NO: 55661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgtttaggcttatgcactaaagatttactg

SEQ ID NO: 55662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcgttttagagtcttgcttggtgatggagtg

SEQ ID NO: 55663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaaaagtttaatgcaccatgagtttgagg

SEQ ID NO: 55664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaaacataccggggttatgtccttcaaag

SEQ ID NO: 55665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaaacatggctaacgttaattcatgcgtt

SEQ ID NO: 55666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaaatatgagtttatgacatgtgcctccg

SEQ ID NO: 55667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaaatatgctaaggcgtatcagagggaac

SEQ ID NO: 55668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaaatgagttgccgatgccgggttaagat

SEQ ID NO: 55669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaacacaatacaggcatcaacggtcatct

SEQ ID NO: 55670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaacgccagaagggttgacatgtggaagc

SEQ ID NO: 55671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaagggatcaggtggataagtacaggacc

SEQ ID NO: 55672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaagttctcgggactacacagtgttatcg

SEQ ID NO: 55673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaatgatgatgctctctgcctttcgttgc

SEQ ID NO: 55674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaattccttggacgtcgtttaattttatt

SEQ ID NO: 55675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctacaggactgcgagggcattcaacctgca

SEQ ID NO: 55676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctacaggaggccctgcaattccgctacccc

SEQ ID NO: 55677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctacatacaggagttgcattcagaccgccc

SEQ ID NO: 55678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaccaaccaattcggaaggacagcccatc

SEQ ID NO: 55679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaccaagtaaaccggcagcagggacggac

SEQ ID NO: 55680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaccctcggggatggattgtcgacaatac

SEQ ID NO: 55681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctacgcacctacctttcattgcctcttgga

SEQ ID NO: 55682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctacgcgatcgaagccaatatgtttgacca

SEQ ID NO: 55683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctacggccttatatttaggaacaggttcca

SEQ ID NO: 55684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctacgggatggtcagtgggctccagaagct

SEQ ID NO: 55685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctacgtacgaaggagatcgggacttgaggg

SEQ ID NO: 55686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctactaatggaggactcaggtaagaggttg

SEQ ID NO: 55687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctactacgcagtcttggtcactacggttat

SEQ ID NO: 55688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctactcaccgcattcgatcagctgccaacg

SEQ ID NO: 55689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctacttatggtgtgcaccgcggggtggcgg

SEQ ID NO: 55690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctactttcgttggggttgttcattcgtagt

SEQ ID NO: 55691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctagactcctcattgtggggaagaaggccg

SEQ ID NO: 55692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctagagctcctgcaaggtttggacagacta

SEQ ID NO: 55693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctagatactcctgtctcagttactactgcc

SEQ ID NO: 55694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctagccattaaccgcgtcatttaaagtcac

SEQ ID NO: 55695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctagcgaactatagacactgctacatcttg

SEQ ID NO: 55696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctagcgcagggatccactgcgacctcttgc

SEQ ID NO: 55697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctagctctttagacaaccgacgctgaacta

SEQ ID NO: 55698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctaggaggaatgtagcatagcctactacgt

SEQ ID NO: 55699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctagtctagcgcagtcagcggcttagaagg

SEQ ID NO: 55700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctagttcctcatactcttgcgcatgggttt

SEQ ID NO: 55701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctagttttatccgcagaagcaagttcgatc

SEQ ID NO: 55702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctatcgctttcgtgagctctgtgttcacta

SEQ ID NO: 55703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctatcggattttcttgttgagttggcatct

SEQ ID NO: 55704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctatgcggtcgcaaatatgggactttcttg

SEQ ID NO: 55705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctatggccggtaggtaatgcgcgtgggacg

SEQ ID NO: 55706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctatgtaggaccgtggacggtgtaactcgc

SEQ ID NO: 55707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctatgtcaagtgtagatgacaccgttaacg

SEQ ID NO: 55708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcaaaatgtgatttaatctatggttgaga

SEQ ID NO: 55709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcaaccagtgaccttcaaactacggtttg

SEQ ID NO: 55710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcaagaaattcgactgtcttgtcactgaa

SEQ ID NO: 55711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcaagtcacggccgattgttctttgagtc

SEQ ID NO: 55712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcaagtccagtggatcttccgaacaggtt

SEQ ID NO: 55713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcaccggcagccaatagctatctgcactg

SEQ ID NO: 55714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcacctaccttccgggatggtcaacgaac

SEQ ID NO: 55715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcacgcttttcattaaacgtgaaggcatc

SEQ ID NO: 55716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcacttcttagaggggtatctactggagt

SEQ ID NO: 55717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcacttggcgggacgggtttatgatacct

SEQ ID NO: 55718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcagatgttttccgcttccgtgttacccg

SEQ ID NO: 55719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcagcatctcgctcccttaaggcgaggta

SEQ ID NO: 55720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcataggccccttaataactttagtctct

SEQ ID NO: 55721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcatatttctagaggcggacatcatgatg

SEQ ID NO: 55722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcatcatcctggtgtgcgtttgttaccct

SEQ ID NO: 55723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcatgaggctatatgcatccggtggtcct

SEQ ID NO: 55724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcatgagtctgggtcttgtgatagttatg

SEQ ID NO: 55725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcatttccctcctaatcgtgctcctctat

SEQ ID NO: 55726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctccaccttctgaatgaggttttcaatcca

SEQ ID NO: 55727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctccactccaagtggttgcgtgctgatcgt

SEQ ID NO: 55728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctccccaattcaccgtacttattgccagcg

SEQ ID NO: 55729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctccctaggcacatggactgccgtgttttt

SEQ ID NO: 55730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctccctcacgttaactacatttcaacaagg

SEQ ID NO: 55731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctccgattgctactatttcttgggtcatgt

SEQ ID NO: 55732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctccggggcgcgcgcgaaagaagtggtctc

SEQ ID NO: 55733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctccggtactttctggtggtataacctgga

SEQ ID NO: 55734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctccgttccgattgtgcagctgttcgttct

SEQ ID NO: 55735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcctcacctctcatgtgatctttgcgatt

SEQ ID NO: 55736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcctcagaataagtggcgcggcgtagtaa

SEQ ID NO: 55737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcctcctgtaaggaatcgcttatctactc

SEQ ID NO: 55738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcctcttgtcataggcatcgtctacttag

SEQ ID NO: 55739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctccttccccgagttttcctggcgttttag

SEQ ID NO: 55740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgacagcaagttacgatcgccggggttg

SEQ ID NO: 55741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgattctcacactcggatggcttctcac

SEQ ID NO: 55742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgcactgttttgccaagagctctgttta

SEQ ID NO: 55743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgcagaagggtgtaggggcacccggagg

SEQ ID NO: 55744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgccagaactcgtttgaattgtatcaag

SEQ ID NO: 55745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgcgagaattttcagtgttgggtccagc

SEQ ID NO: 55746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgcgtgcacactaaacgatgggttactt

SEQ ID NO: 55747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgctagccagcctagtataggaatacga

SEQ ID NO: 55748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgctccggccgcgttgtgaaacccagca

SEQ ID NO: 55749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcggaggcagccgctcgtcttagcagcaa

SEQ ID NO: 55750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcggcagttgttagcgctagctagtgggt

SEQ ID NO: 55751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcggcttggctattgtgcagcgatgtatg

SEQ ID NO: 55752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcggggttttacgtttcgctacaggattg

SEQ ID NO: 55753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcggtccgctgtcagttgggaatcgaaac

SEQ ID NO: 55754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgtgcacttgcacttctcacagtctcgc

SEQ ID NO: 55755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgtggccccaacgactgtttgggacttg

SEQ ID NO: 55756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgtgtatcgacggtcgatcgttgcaaga

SEQ ID NO: 55757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcgtgtccttacttcgttgcttggtttgc

SEQ ID NO: 55758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctctaatcgtcttgcacgaacgaccgctgg

SEQ ID NO: 55759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctctactcaccagcttttcacctgtttcca

SEQ ID NO: 55760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctctcatgggcccgcggcaaccagaacgtc

SEQ ID NO: 55761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctctcgttaaatgggcttgcccgtttcgtc

SEQ ID NO: 55762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctctctgctgccttctccggtctctgaata

SEQ ID NO: 55763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctctggctatgtactaggattcggactcgc

SEQ ID NO: 55764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctctggggggataatgcgccaacgggctgt

SEQ ID NO: 55765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcttccctcctcatgggtctatctcaacg

SEQ ID NO: 55766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcttccgattccaaggggtcgtctgctgc

SEQ ID NO: 55767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctcttgacaagcatcgggcttttgctatgt

SEQ ID NO: 55768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgaaatcgaaagcacagcacatggcaatc

SEQ ID NO: 55769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgaactgcgaaacggccttacctgcattg

SEQ ID NO: 55770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgaagctagccacacggactggtaactat

SEQ ID NO: 55771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgaatcgatggcttctctcacctcaactc

SEQ ID NO: 55772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgacaccacccgtgcttggggccttaggc

SEQ ID NO: 55773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgacatgttccatggtaagaaggtcggtg

SEQ ID NO: 55774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgaccggtttctaggctagtggtttcccc

SEQ ID NO: 55775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgagatcacaactccagaagttcgttctg

SEQ ID NO: 55776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgaggaccgtccgtaaagagtgaggtccc

SEQ ID NO: 55777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgagggcgcgggggacctttagttggagg

SEQ ID NO: 55778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgataacgcgcatggggtgccgacgagac

SEQ ID NO: 55779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgataggcgcattttcacgttactaactc

SEQ ID NO: 55780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgatgcaaatacaactcaattgtggctga

SEQ ID NO: 55781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcaccaatccatcagatttggtcgtaag

SEQ ID NO: 55782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcagctttacgatccttctgactacgcc

SEQ ID NO: 55783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcattgttgaaccacataatgaacaccg

SEQ ID NO: 55784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgccacactgcgataagaatttcatttct

SEQ ID NO: 55785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgccccttggagcatacactagggcagtg

SEQ ID NO: 55786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcccgtattaggtcatccgacatggtgc

SEQ ID NO: 55787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgccgcgtcggtcgatacattaccatggc

SEQ ID NO: 55788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgccgcgttctagaaggcgcactttcgtt

SEQ ID NO: 55789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgccgtacagccaaccgcctgggagactc

SEQ ID NO: 55790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcctatctggaattcttcatacacggga

SEQ ID NO: 55791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcctgcagttagagccgcttgaccttga

SEQ ID NO: 55792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcctttccttgttatcggttacggtctc

SEQ ID NO: 55793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcgaagacggcaagaaggtgctgataga

SEQ ID NO: 55794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcgagtcgatctgtttgactttgcgccc

SEQ ID NO: 55795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcgatagtatatgacttgggcctagacg

SEQ ID NO: 55796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcgcacaggtgggtcaggggttttgtgg

SEQ ID NO: 55797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcggcccagtgacggcaacgaagcgcct

SEQ ID NO: 55798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgcgttccgggatcggaccgacttaggcg

SEQ ID NO: 55799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgctatgtcactggtcagtcccggtttcg

SEQ ID NO: 55800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgctctgcatgaggatggggcgagggagg

SEQ ID NO: 55801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggaatagaattgtcgttcggtacccttg

SEQ ID NO: 55802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggacctttcttacggtgcttatcggcca

SEQ ID NO: 55803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggatgcgggtccaagttccggcggtgtc

SEQ ID NO: 55804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggatttagaatggttagtaagtaccatg

SEQ ID NO: 55805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggcagcggcgatagggaatggggtcagg

SEQ ID NO: 55806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggcagggttcggctcctgaacgtattcg

SEQ ID NO: 55807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggcatcatagcacccgcgttgaccgggg

SEQ ID NO: 55808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggccagcatcgctagttgaggccgaacg

SEQ ID NO: 55809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggcgaaagttatggtcaaggcggttgga

SEQ ID NO: 55810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggctgagatcatgtcagaaaagaggctg

SEQ ID NO: 55811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgggagaggagcaggcgtggtgaccagga

SEQ ID NO: 55812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgggcgaagacaggactgatggattagca

SEQ ID NO: 55813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgggcggaatcgtcatttgaatggcttgt

SEQ ID NO: 55814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggggaaagtggtccgaccagctgatgga

SEQ ID NO: 55815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggggagacggaccgggactacgctttcg

SEQ ID NO: 55816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggggtagcgtctacagcgatgcgtgtcg

SEQ ID NO: 55817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgggtagggctacagtgtctgcgacaagg

SEQ ID NO: 55818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgggtcgatcggaacaagcggtggaagcg

SEQ ID NO: 55819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggtactctggggtcttacttgtcacgac

SEQ ID NO: 55820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggtgatttacgcccgctgtagttttagc

SEQ ID NO: 55821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggtgcttcgccaatgtttgcactcccat

SEQ ID NO: 55822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggttggagtctgtggacttagcgacgcg

SEQ ID NO: 55823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctggtttggcagatgaatcgcccgccgtag

SEQ ID NO: 55824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtagcaggagggcttatggtggtctggt

SEQ ID NO: 55825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtagcgttgtgttccgtggtgccacata

SEQ ID NO: 55826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtagctgttgacggcaccggcaaggctg

SEQ ID NO: 55827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtaggtagaaccggcccaagtcgtagct

SEQ ID NO: 55828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtatagctgcaagggccggacgccgtca

SEQ ID NO: 55829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtatcaagtgttagggaattccacaatc

SEQ ID NO: 55830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtcaaggagaaccctgaggattcgagcc

SEQ ID NO: 55831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtcctgcggtgttgcatatcagtggata

SEQ ID NO: 55832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtcggtctgatggtaacgttgaacgtga

SEQ ID NO: 55833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtgaaccaaatacgaatttggactgagc

SEQ ID NO: 55834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtgacaaggatgggccccgatcactcca

SEQ ID NO: 55835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtgccccaagcatgtcgccgtgacgtgg

SEQ ID NO: 55836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtgcggggtgctagtcgtcgcccagtgt

SEQ ID NO: 55837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgtggattgtccttcttttgctgtcactc

SEQ ID NO: 55838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgttatctagtgctttaccgcttcccgaa

SEQ ID NO: 55839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgttgggatttgtgcatctcgcttcttgt

SEQ ID NO: 55840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctgttgggtttgctcggacaaaggtcgggc

SEQ ID NO: 55841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttaacttccggatatccttgtttggggtg

SEQ ID NO: 55842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttacacctaaagagcgaccagggtgctta

SEQ ID NO: 55843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttaccgcgtacactctccgtaggctcaca

SEQ ID NO: 55844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttaccggactgctaaggcgacttcctcgt

SEQ ID NO: 55845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttaccgtgtgtaaaacatagacggcggcg

SEQ ID NO: 55846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttacggccatgtaaattgggcaggctcgt

SEQ ID NO: 55847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttacgtgcagactgtagacctgtgaagat

SEQ ID NO: 55848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttactcgtccccctttacaattggacctg

SEQ ID NO: 55849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttactggatgagataacgcttgtctcgca

SEQ ID NO: 55850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttagagggcggtgcggagtgttcctctga

SEQ ID NO: 55851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttagatccgtgcggtatatggtctcatac

SEQ ID NO: 55852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttaggtgttatattacaggaacggggtgc

SEQ ID NO: 55853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttatccttaccggaggggatctggttata

SEQ ID NO: 55854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttatgccttggacggttataggatcatgc

SEQ ID NO: 55855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttatgctgtcagggggggcgaacaccaga

SEQ ID NO: 55856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttatggcaatgggtcagcaacacctgtcg

SEQ ID NO: 55857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttatggtaggaggcagtgttgtaaccctg

SEQ ID NO: 55858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttcaactggatcccggctttcttggcgtc

SEQ ID NO: 55859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttcaagttataaggggtttgacagatgcc

SEQ ID NO: 55860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttcaatcgaaagtggatactatgggtaac

SEQ ID NO: 55861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttcacgcgctcagttcggtagctgtttga

SEQ ID NO: 55862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttcatacctccgcgttaggagttcgcggg

SEQ ID NO: 55863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttcatctgaccaactcttgtggcaattta

SEQ ID NO: 55864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttcatttctcgtttcacttcccttatcaa

SEQ ID NO: 55865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttcccctgggtgcgtctccagtgtcactg

SEQ ID NO: 55866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttcctcgtgaggcacgcgacggttcatcc

SEQ ID NO: 55867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttcgtatttttttttgatcgcgacagcga

SEQ ID NO: 55868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttcgtgtgatccttaccaatacttttacg

SEQ ID NO: 55869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttctgcaagttctcgtatggagtcatgtg

SEQ ID NO: 55870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttctgctggaccttctcctgctgtccaaa

SEQ ID NO: 55871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttctgggaatacatgatcatgggatctaa

SEQ ID NO: 55872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgacagggagcgtgtttagcaggttgtg

SEQ ID NO: 55873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgagggcgacgccgttttggtcggggca

SEQ ID NO: 55874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgatatcaagcactcaccttttcccgtg

SEQ ID NO: 55875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgatcaccgccagcatcacacgatcgct

SEQ ID NO: 55876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgcaggcagcaatgttttgaaatggagg

SEQ ID NO: 55877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgcctgacaaccgttgcgcgagttaagc

SEQ ID NO: 55878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgcttttattgccggcccccttcggaat

SEQ ID NO: 55879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttggaccggttcgtactgacttttgtgtg

SEQ ID NO: 55880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttggagttcgttaagtgccggatacaaga

SEQ ID NO: 55881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgggagttctgagttgtatttataatgt

SEQ ID NO: 55882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttggggtgcccgtcagctgggattgatgt

SEQ ID NO: 55883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttggtgtgactcgctaatactagtcgttc

SEQ ID NO: 55884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgtcgtaggagttggtccgccttggatg

SEQ ID NO: 55885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgtcttagacttgtcagtcgggtcggtc

SEQ ID NO: 55886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgttatcttcataaagtacgcacgcgcg

SEQ ID NO: 55887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgttgacagttggaagccaatttattgt

SEQ ID NO: 55888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttgttgaggaagcacgtcaccgtcccgtg

SEQ ID NO: 55889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttaaagatttcgaccataaggaggccga

SEQ ID NO: 55890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttaaccattgtcaattgagctgtttctg

SEQ ID NO: 55891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttaacgtttgcggcagccggcatgttcg

SEQ ID NO: 55892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttacactttaccatttgatgtttcaccg

SEQ ID NO: 55893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttacatttttggtgtggcggggaccgtt

SEQ ID NO: 55894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttcgcagtaatcgcctgtatgtgttctc

SEQ ID NO: 55895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttcggcttccttgctcaccaacttgttt

SEQ ID NO: 55896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttctcctcttcgctgtcgcttagcctgg

SEQ ID NO: 55897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttcttcgtgttcgttaggtttcttccta

SEQ ID NO: 55898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttgatataactttttcaagatggctcga

SEQ ID NO: 55899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttgggcactacaacgacgatgcgacggt

SEQ ID NO: 55900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttgtagggttgaatttcttgagggatgc

SEQ ID NO: 55901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttgtattgaagtttattttccgagcggt

SEQ ID NO: 55902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtctttgtttctattggctattgccttagtca

SEQ ID NO: 55903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttttagtcgtaggacgttgctttcgggcg

SEQ ID NO: 55904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtcttttctgatgaagcaaacattatgtttac

SEQ ID NO: 55905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaaaagggctcaacaggggcttggacacgt

SEQ ID NO: 55906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaaaatcagctcctgtttggcagcctttga

SEQ ID NO: 55907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaaatagcccgtcacctggagactgtatca

SEQ ID NO: 55908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaacaacggagtgtggtgcagtctgccctt

SEQ ID NO: 55909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaacattgatcacggaagcctataaactcc

SEQ ID NO: 55910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaaccagacgatccactggcgacaggatag

SEQ ID NO: 55911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaacccgggctagcgtgtgcgggtctggct

SEQ ID NO: 55912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaaccggcacgcgctgaacatggcactgtc

SEQ ID NO: 55913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaacctcggacgcggcaactcttggcactt

SEQ ID NO: 55914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaacctctcggatcgcatcgacaccgcgtt

SEQ ID NO: 55915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaacggggtcggcaacgcggctatctggcg

SEQ ID NO: 55916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaacgtacacgcgctggggctcggccgcaa

SEQ ID NO: 55917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaactccacggcggggtggattccagacgt

SEQ ID NO: 55918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaactgatcaatacggggaacaatcgtggt

SEQ ID NO: 55919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaacttatgcaggaggctggaagcactgga

SEQ ID NO: 55920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaacttccttgcccgcataatttgtcggtc

SEQ ID NO: 55921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagacttgttgctcgtaccccgacctcgc

SEQ ID NO: 55922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagagcgtgacaaccgagtctcttgctta

SEQ ID NO: 55923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagatgactgcctaatacagatggtgtag

SEQ ID NO: 55924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagatgtccaggcgttcattgacagggct

SEQ ID NO: 55925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagcagcactatgatagtttacttatgac

SEQ ID NO: 55926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagcctcattccacgcatgtttcagcccg

SEQ ID NO: 55927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagctgccgccgaatggtttgctcatggg

SEQ ID NO: 55928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagctttacggccgtgaaagactgaaaac

SEQ ID NO: 55929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaaggtcgggctttgattgtcttggactaa

SEQ ID NO: 55930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaaggtgacggtgcaacatctgcgcaatga

SEQ ID NO: 55931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagtaggtgctgtagctgtttgggtggcg

SEQ ID NO: 55932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagtcaagaatcactacatctcgtggacc

SEQ ID NO: 55933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagtcagtcaatcgtgagagcattagctt

SEQ ID NO: 55934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaagtttgttaggtttagagctaacgtggg

SEQ ID NO: 55935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaataagtgtcctccgagctcgctatcatt

SEQ ID NO: 55936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaatatgacaaggtatcgtgtagggatagg

SEQ ID NO: 55937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaatcacggctcctgctcgcgttcagtggc

SEQ ID NO: 55938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaatccccatacccatggtatcgtagcctc

SEQ ID NO: 55939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaatccccggaccgcgtagagtgtgcagct

SEQ ID NO: 55940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaatcgcacttcgccgcttccggtcctttg

SEQ ID NO: 55941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaatcgtcatctcgtcatggggtcagggtg

SEQ ID NO: 55942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaatgatgcatcacgaagtagttagatcgc

SEQ ID NO: 55943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaatgctaatcccgcttcgatggggcgggg

SEQ ID NO: 55944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaatgctggtctgaagtcgtgcctggtccc

SEQ ID NO: 55945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaattgattacctacgtccagtggtataga

SEQ ID NO: 55946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaattgtaggctctgcatctcgtggacatg

SEQ ID NO: 55947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacaaagcgactgcaactatctgaagatgg

SEQ ID NO: 55948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacaaagggcaacacgcgagttacgaacgt

SEQ ID NO: 55949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacaactacgctactctcctaatagatgcg

SEQ ID NO: 55950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacaactgtaggcgatcccaggctctccga

SEQ ID NO: 55951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacaagcctggactcaagacgtactcacgt

SEQ ID NO: 55952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacaaggcctggataccttgcgcgcagaag

SEQ ID NO: 55953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacaaggtggcgtcaaggggacgtgatcgt

SEQ ID NO: 55954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacacaggtatggcccgcatcgctagtgcg

SEQ ID NO: 55955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacacgattctgcgtcgaatgtaaagcttt

SEQ ID NO: 55956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacacgctctacccctttccgatctttttt

SEQ ID NO: 55957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacacggataatggcttgttgggcctctgg

SEQ ID NO: 55958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacacgtatacaggatatcacttatgctgg

SEQ ID NO: 55959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacacgtctattccgtttgttcacccacgc

SEQ ID NO: 55960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacactcccataatgtttacttggtccacc

SEQ ID NO: 55961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacagacttcactccgtttatgtaagcgtt

SEQ ID NO: 55962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacagctggtccgatgaaaccgcgacgcat

SEQ ID NO: 55963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacagcttggatgaggacggagggtgtgcg

SEQ ID NO: 55964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacagggctacgggcagggtacgatgtcta

SEQ ID NO: 55965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacagggttttctattgtgtcggcgtcttg

SEQ ID NO: 55966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacataacggtgcgtacataaaccgtcgtc

SEQ ID NO: 55967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacatactcatctccttgaatcatggttcc

SEQ ID NO: 55968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacatcggcccggtttagcagtttgccccc

SEQ ID NO: 55969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacatgcctcggcgggcgcgggtcggccgg

SEQ ID NO: 55970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacatgcttataactccatggcctttgatc

SEQ ID NO: 55971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacatttatatcgttcagtctgtttcctct

SEQ ID NO: 55972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaccaacggcattagatcacacaggggaca

SEQ ID NO: 55973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaccaatgctcgccatcaataggatccgtg

SEQ ID NO: 55974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaccaccgacaatttgcgtgcgttcatgag

SEQ ID NO: 55975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaccaccgttctctgccgcgtagcccgtcc

SEQ ID NO: 55976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaccagtacggttcaagcccaagtgccggg

SEQ ID NO: 55977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaccccggagtaaccgaaaatggatggagt

SEQ ID NO: 55978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacccgaccatcactactaaaaaggatcga

SEQ ID NO: 55979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacccggcccgagttagcaactgcagcagc

SEQ ID NO: 55980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaccgaagtcagaaatcggtgcagcgagtt

SEQ ID NO: 55981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaccgacccccggaaatgttcccattatgc

SEQ ID NO: 55982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaccgcctcaggctacctttgttgtgacgt

SEQ ID NO: 55983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaccggcgcagacaaatgtattccgtcgcg

SEQ ID NO: 55984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaccggtaaacattaggccctatgcgaagg

SEQ ID NO: 55985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacctaccgtgcgctgttctacttggcttt

SEQ ID NO: 55986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacctgaaatcttaggatgtccgtaagtac

SEQ ID NO: 55987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacctgtccagctatatcgcgcgttaagtg

SEQ ID NO: 55988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacctttgtggtacgggtggtgttcgactc

SEQ ID NO: 55989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgaacttgtaaactgttaaaagtaatgt

SEQ ID NO: 55990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgaaggtttaggaaaacactcgcccctc

SEQ ID NO: 55991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgacacagcagatatcgagcggccggct

SEQ ID NO: 55992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgacaggaaagcatcgtctcttcgggta

SEQ ID NO: 55993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgcacgagtaggtgttataatttgtgcg

SEQ ID NO: 55994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgcgatatgtcccttctggtgatccgta

SEQ ID NO: 55995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacggcgggaacgattcgacttcgtctgcc

SEQ ID NO: 55996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgggtctgcgatcaggagtgctcgtgtt

SEQ ID NO: 55997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacggtgctgattacatggctgcttcttcg

SEQ ID NO: 55998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgtatggtctacgctgatctgcggactg

SEQ ID NO: 55999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgtcatgctcacgaggtacacaaggggg

SEQ ID NO: 56000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgtcggcggcaatccgggggtaccagct

SEQ ID NO: 56001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgtctgaggatggcggaatacagctctg

SEQ ID NO: 56002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgtggatccaggcttcgaagggacggct

SEQ ID NO: 56003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgttagttcattgtttcccttcacatgt

SEQ ID NO: 56004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacgtttcgcggtccgagcgggtttgactg

SEQ ID NO: 56005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactacatgttctcgtagagggtacctacg

SEQ ID NO: 56006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactaccgcgggggggatggttgtgctcgt

SEQ ID NO: 56007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactagcgcttacttaggctcctaggaacg

SEQ ID NO: 56008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactatgaaggtcccacggggatgcctgtt

SEQ ID NO: 56009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactatgactttgtgacacatccagttgac

SEQ ID NO: 56010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactattggatggtagactccggttctgtt

SEQ ID NO: 56011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactcaccggtgccacatcttctgggaatc

SEQ ID NO: 56012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactcattaaggtagcaatgcctgctcgct

SEQ ID NO: 56013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactcgggttgtgatcacagtggtgcgtgt

SEQ ID NO: 56014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactgcaaggctacacggaagcacccgcac

SEQ ID NO: 56015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactggccaacgctagggaagctattcggg

SEQ ID NO: 56016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactgggtgtttgaagagtcttgcatcgat

SEQ ID NO: 56017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactgtaaggtggtgggttctatgtgcggg

SEQ ID NO: 56018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactgtacgcgctggaggtaaggtgccccc

SEQ ID NO: 56019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactgtatagtgcttagctggttatcgtgg

SEQ ID NO: 56020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgactgttgtgctctggtaatggcgggccgt

SEQ ID NO: 56021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacttagagctcccagttagttaagctgcg

SEQ ID NO: 56022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacttcacttgaaggcccagcgacttttgc

SEQ ID NO: 56023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacttcgcagaggtccctatggctgatgtc

SEQ ID NO: 56024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacttcgtttcttactacaacttagatggt

SEQ ID NO: 56025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacttgatgggcctgtaggtgcatccgact

SEQ ID NO: 56026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgacttgccaaacaatgcgctgacgaggcgg

SEQ ID NO: 56027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagaatgctggagcctactcggtatgcggt

SEQ ID NO: 56028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagaccccggttttcatcgtggcgagggcg

SEQ ID NO: 56029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagacgcttcaaactgtgcacacactccga

SEQ ID NO: 56030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagacgcttgttcctacgatgcgagaagcc

SEQ ID NO: 56031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagactctgaccagcaacgggccatttcgt

SEQ ID NO: 56032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagagccaagttgagtgcaattgcagcttt

SEQ ID NO: 56033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagagctctcaaaacagggtacattctcga

SEQ ID NO: 56034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagatagaaggggtgactttgcgggagttc

SEQ ID NO: 56035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagatgatgcagcaccgcttcctggccatt

SEQ ID NO: 56036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagatggttgccgtaatgtttagttaacca

SEQ ID NO: 56037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcaactcgttattcgcggtcgccgcggg

SEQ ID NO: 56038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcaagaaaacaaaggtgcaggtaggcga

SEQ ID NO: 56039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcaagcacttgggtctgccagcgtgtga

SEQ ID NO: 56040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcaagctgtaatatatcatggagcccgc

SEQ ID NO: 56041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcaagggcgcaaacgattggtaggcgtc

SEQ ID NO: 56042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcaataaatctgccgatgctaggatctt

SEQ ID NO: 56043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcagacgattgtattctcccgaatcgcg

SEQ ID NO: 56044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcagcggcggtggaattcgtgtgcgggg

SEQ ID NO: 56045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcagggcatcagcggaccagaccgtgct

SEQ ID NO: 56046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcaggtggatactgacaatcgcccaacg

SEQ ID NO: 56047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcatacgctattgcacgattgtatcgta

SEQ ID NO: 56048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcatctaaatgttcatgtcccgcgttaa

SEQ ID NO: 56049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcattttatgacgagattttctcgtctg

SEQ ID NO: 56050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagccacttttccaacaccgtagtcgaact

SEQ ID NO: 56051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagccagcggtagaccgaagcagcgttagg

SEQ ID NO: 56052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcccaaatgttcttcggttacttagggt

SEQ ID NO: 56053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcccgtctagccacagggtcaaagagtg

SEQ ID NO: 56054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagccctccggacacaactcgtagcgcgca

SEQ ID NO: 56055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcgagtgggctagggggtttaggatacg

SEQ ID NO: 56056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcgcctgcatgttgtctcacgcgtcttt

SEQ ID NO: 56057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcgcgccgacacgtgacccactaaggcc

SEQ ID NO: 56058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcgggttcgtctcgaatatgagagacct

SEQ ID NO: 56059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcgtagtctgaatctaaggtcctgctta

SEQ ID NO: 56060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagcgtgagttcctgggtgggacgtcggag

SEQ ID NO: 56061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagctggagagtatccgttgcccgtaatat

SEQ ID NO: 56062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggaaaggattcttcacactgtgccgact

SEQ ID NO: 56063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggaacaacttgcagacctgcgaaaggat

SEQ ID NO: 56064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggacctgcgccttcacgtgtttgttcgt

SEQ ID NO: 56065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggagcagcgtcactctccgtggaggtga

SEQ ID NO: 56066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggaggtggatttttggcatcgtgcaaga

SEQ ID NO: 56067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggatctggagtgctgtcggttgcgtccg

SEQ ID NO: 56068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagggatcatcgtggaaccgtgtcaccgga

SEQ ID NO: 56069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagggcacgggaaagcagcagcaaagcgtg

SEQ ID NO: 56070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagggccattgcgttgcatgcagcggggtc

SEQ ID NO: 56071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggggcgtatgaacttatggctagtagtc

SEQ ID NO: 56072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggggtgggtaactggatcacggcgtgca

SEQ ID NO: 56073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagggtcagaggcgtaacagagtttgctcc

SEQ ID NO: 56074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagggtggctggcagcggtcttgcgggtcg

SEQ ID NO: 56075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggtaggtcttgtagagggtatgtatatc

SEQ ID NO: 56076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggtcggattggcgggggagccgtgatag

SEQ ID NO: 56077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggtcgggcgtggattggcacaaagattg

SEQ ID NO: 56078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggtgattcgatccgcccatagttggtcc

SEQ ID NO: 56079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggttatcgtgttcgtacgtgcacagtta

SEQ ID NO: 56080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgaggttgctagaacaagatcaactgtagga

SEQ ID NO: 56081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagtaaacgtcgctgcagcatagctcgact

SEQ ID NO: 56082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagtaagtaacgatcctaatatgtgaactt

SEQ ID NO: 56083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagtacggctatgaaactgcgcggcgtgta

SEQ ID NO: 56084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagtacgggatcgctcaagttgcacgccgg

SEQ ID NO: 56085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagtattacgaactgggtaggggggatgat

SEQ ID NO: 56086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagtgcttcgttctggataaccataactct

SEQ ID NO: 56087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagtgcttggcatttggttgcggggtaggg

SEQ ID NO: 56088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagtgtatttcttatctgctttaaatgtac

SEQ ID NO: 56089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgagttaggccaaggttgtgcggaagtctaa

SEQ ID NO: 56090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatacaagttaatcgccgatgctctgcgcc

SEQ ID NO: 56091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatacacgggtcagccgacgtgattaagat

SEQ ID NO: 56092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatacggcgttggtatcatggtacttcttt

SEQ ID NO: 56093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatacgttagcatcatagggcctcttttgt

SEQ ID NO: 56094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatacttttacgtcgagccgaattgttccg

SEQ ID NO: 56095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatagactctcgaatttctccgttataaac

SEQ ID NO: 56096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatagcgaggtgtccgcatctcttcaacgg

SEQ ID NO: 56097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatagtcggcttagctagggtgcttggccg

SEQ ID NO: 56098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatcagtaggtttgtcacggacttgttgtc

SEQ ID NO: 56099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatcatggggctgacgaacattagcaccga

SEQ ID NO: 56100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatccatgtaatcgacctgattgtacaact

SEQ ID NO: 56101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatccgatgtgtagatggcggttcggctaa

SEQ ID NO: 56102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatccgcgcggatactatgggggcaatctg

SEQ ID NO: 56103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatccgttgcatgctctttacgttttactg

SEQ ID NO: 56104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatcgatatgaccttcgctccccgtgtgga

SEQ ID NO: 56105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatcgatcattttgtccggtaacgatttct

SEQ ID NO: 56106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatcggagagggcggtcggtgtagcacaga

SEQ ID NO: 56107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatcggcctcaattctttcccagagacacc

SEQ ID NO: 56108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatcggcttactattcagaattgtattgtc

SEQ ID NO: 56109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatcgggcgtgggatgagcagaggccagac

SEQ ID NO: 56110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatcgggctaaagatctctcgcccgcgaca

SEQ ID NO: 56111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatcttccggccgtgtacctctggcaatag

SEQ ID NO: 56112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgaaccatgtacattgcgttacctccgt

SEQ ID NO: 56113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgacaaattgtacaagtatgacacatgc

SEQ ID NO: 56114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgagccaacagaccttgtccaggatccc

SEQ ID NO: 56115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgattccctggtctcctatgatcgaggg

SEQ ID NO: 56116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgcagctaggcatgatcatggatgtaag

SEQ ID NO: 56117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgcataccatctaggtaaccgacagcgt

SEQ ID NO: 56118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgccatatgcaacggtttcacgccggtc

SEQ ID NO: 56119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgcccacctctacgggacagccgcgaga

SEQ ID NO: 56120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgccctcaccaggattctaggcatgttt

SEQ ID NO: 56121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgccctgagctaattagatcacctcatg

SEQ ID NO: 56122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgccctgttgtatgtatatgtaatcctc

SEQ ID NO: 56123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgccgaatgtagatcctttgggccggcc

SEQ ID NO: 56124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgcgcctcattggtaaggggggtcctgt

SEQ ID NO: 56125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgctccagatctcagagctaactgctca

SEQ ID NO: 56126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatggccacccgcatgagactcgtgtcagg

SEQ ID NO: 56127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatggtgattcgagccgctgttacgttacg

SEQ ID NO: 56128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgtaggtatctgcacatagtaggggaag

SEQ ID NO: 56129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgtgctggaaacagtgcttcatgttagg

SEQ ID NO: 56130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgtgggaatgttgtgtgcgcttacttac

SEQ ID NO: 56131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatgttgatgcacgttcaataaagactcgg

SEQ ID NO: 56132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgattacaaatgtggtaaacaataacatccc

SEQ ID NO: 56133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgattagggtggatttggcctgtcacatctg

SEQ ID NO: 56134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgattcttcggccactgcctgtctcccttgc

SEQ ID NO: 56135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgattgcccgggtaccgaagagcggcagcga

SEQ ID NO: 56136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgattgcgggtccctgtttactggcataagg

SEQ ID NO: 56137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgattgggtcgtgcagcagctaagtcatcgt

SEQ ID NO: 56138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgattggtaaatggtcatgtggagctgggtc

SEQ ID NO: 56139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgattgtatacaccacatcctggaacttgcg

SEQ ID NO: 56140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgattgtgtgggtctgtacacgctctacgct

SEQ ID NO: 56141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgattgttaatcttccgtttagcacgccgtt

SEQ ID NO: 56142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgatttgggcgtggtcatagcgcagcttggg

SEQ ID NO: 56143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgattttctctcaccgtgtttggatggccta

SEQ ID NO: 56144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaaacatttcctacagctccgaatgtccg

SEQ ID NO: 56145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaaacggatcagcgcttctcacgctgcct

SEQ ID NO: 56146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaaagagccccgtgcttcgtaaagcgtct

SEQ ID NO: 56147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaaaggcttcttcagcacgcaggtcggcg

SEQ ID NO: 56148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaacacctccctgcttagcaatgtgataa

SEQ ID NO: 56149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaacatccgtatcaaggttctctctacag

SEQ ID NO: 56150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaaccataagccgcgtatcgtctccggca

SEQ ID NO: 56151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaacgaaggcgctagaacttttcgcctac

SEQ ID NO: 56152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaacgattcatgcgtaattcgacttggtc

SEQ ID NO: 56153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaacggtcctctttctttgttgccgttct

SEQ ID NO: 56154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaacgtttggtttctggtagaccaccagg

SEQ ID NO: 56155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaacttcgtcatcccgttgcttatccgtt

SEQ ID NO: 56156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaactttctattttctggcgataaaactg

SEQ ID NO: 56157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaagacctgctggaacgaccacgcatgcc

SEQ ID NO: 56158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaagcccgcacacgttgactatggcggtc

SEQ ID NO: 56159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaagccgcggctcacgtagtctgacgggc

SEQ ID NO: 56160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaaggactcaactagcgtattatcatttt

SEQ ID NO: 56161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaaggcggcctccgttccgattgctcagt

SEQ ID NO: 56162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaaggggtgggataatcttgttcggcact

SEQ ID NO: 56163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaagtgcggaaaacaaaaattaagtgtcc

SEQ ID NO: 56164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaataccggcatatggcccgcaggattcg

SEQ ID NO: 56165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaatagaggtttagcaggctggtaaggcg

SEQ ID NO: 56166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaatcatattgtggtactcatgatgacgc

SEQ ID NO: 56167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaatcgagacgcttttagcgcagggtggc

SEQ ID NO: 56168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaatcttcctgtactgttgcgtttaatct

SEQ ID NO: 56169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaatgccgaatacccggaagtagtaaggt

SEQ ID NO: 56170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaattacttcgttacgcgatggacattgg

SEQ ID NO: 56171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaattagtatcctcctgttaggctgccgg

SEQ ID NO: 56172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacaaccacagcactagcacctcgcatgc

SEQ ID NO: 56173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacaacgcgagcaacgtttgaacggccaa

SEQ ID NO: 56174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacaagtccagtccatgcctcggcattct

SEQ ID NO: 56175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacaatgtactggggattaggcgatgatg

SEQ ID NO: 56176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacagtaaaggttgaggtcattgccgtag

SEQ ID NO: 56177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacagtccacctgaggcgtctcgtctggg

SEQ ID NO: 56178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacataattcaagaactagtcaacgaatc

SEQ ID NO: 56179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacatccgtccaggaagtgggagagggtc

SEQ ID NO: 56180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacatggagcaatctatcgggacctaggt

SEQ ID NO: 56181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacattggggtagatgttcctagtccgtg

SEQ ID NO: 56182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaccacgggcccggttacgcttagctatg

SEQ ID NO: 56183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaccattttgtgcagcgggtggcctgttg

SEQ ID NO: 56184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaccgcgggcacagtcctgtctcttttgg

SEQ ID NO: 56185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacgccacacgcaaatattccttccctgt

SEQ ID NO: 56186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacgccacgagggtcactcggatcttccc

SEQ ID NO: 56187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacgccagggtgccgtccctctttcagtt

SEQ ID NO: 56188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacgccgagattacgagaggtcaggagtg

SEQ ID NO: 56189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacggaatggggataccaagaggtttcat

SEQ ID NO: 56190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacgggatcacgttcaagtatcgcgcccg

SEQ ID NO: 56191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacggtaagtggggtgcaaggagggggtg

SEQ ID NO: 56192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacgtcggaacccaccggtggctggctct

SEQ ID NO: 56193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcactaatcccttagccgcctgttcgaccg

SEQ ID NO: 56194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcactcaggttttcacttactgaactattc

SEQ ID NO: 56195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcacttatctgcagcatctaagtgtggttt

SEQ ID NO: 56196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagaaagtccagagttatcaactcgtgga

SEQ ID NO: 56197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagaacaggcagccttagtattagatctg

SEQ ID NO: 56198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagaactctgccgccatagagtttcggtt

SEQ ID NO: 56199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagaatcactcgaaaccgaggcagcgggc

SEQ ID NO: 56200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagaatcgaggcgcatcagtaggccggag

SEQ ID NO: 56201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagaatgattcgtgaaacacttgtcgcct

SEQ ID NO: 56202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagagatccagaagatagcgcgaggccac

SEQ ID NO: 56203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagagcggtgtttgtgcgaatggcctgcg

SEQ ID NO: 56204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagccctggtttcggaggtaacattagtc

SEQ ID NO: 56205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagcctcgtcgtagtggcgtaggtgattg

SEQ ID NO: 56206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagcctgaggattccggtttctcagtaag

SEQ ID NO: 56207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagcgccattcgacagggcctgtctggtc

SEQ ID NO: 56208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagcgcctgcccggttccgcgacgcgtcc

SEQ ID NO: 56209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagcggatgtacagcccgggcaacttcct

SEQ ID NO: 56210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagctactccactttcaaactctagtcgt

SEQ ID NO: 56211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagctcgctcgccatttatgattcttggg

SEQ ID NO: 56212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagctgccacgttcgtctaggtgtttccc

SEQ ID NO: 56213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagcttgaatgcggatggcgactagggat

SEQ ID NO: 56214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaggagcagtagggcgggctccgaatgtg

SEQ ID NO: 56215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaggcatcaggttaccgacaggactaggg

SEQ ID NO: 56216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagggaagctggtgcctgcagtggagtcg

SEQ ID NO: 56217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagggcccgattgcgccgagaatgcggct

SEQ ID NO: 56218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagggcggggtcgcagcttgtttgccgtt

SEQ ID NO: 56219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagggctgttatcctgtggaggctggacg

SEQ ID NO: 56220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagggtcattccctgatctccgtctggtt

SEQ ID NO: 56221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaggtgcgatggggagctactagtatggg

SEQ ID NO: 56222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaggttcaaagtccaacatagcgttcagg

SEQ ID NO: 56223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcaggttgaaagcggttttggtccacacgc

SEQ ID NO: 56224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagtacagtgttccttggcgtgtaacgcg

SEQ ID NO: 56225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagtgactggaaaccaccgggatcgcccg

SEQ ID NO: 56226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagtgctctttacatccgtcattagaccc

SEQ ID NO: 56227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcagtgtagtggtatgaggaactaacctta

SEQ ID NO: 56228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcataattcactgttaaagcgctcttttcg

SEQ ID NO: 56229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcataccactgtaacgccgtttgtatgtgt

SEQ ID NO: 56230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcataccggcctggcccgtcaatagtgggg

SEQ ID NO: 56231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatacctcggcagagtgctgtttgcggat

SEQ ID NO: 56232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatacgcctatcggtctgttaattgttgt

SEQ ID NO: 56233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatatcgtggaacctacactcgaagggct

SEQ ID NO: 56234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatatggcccttgtgcggttagtttttgg

SEQ ID NO: 56235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatcactcttaaagtatctgcactgagtg

SEQ ID NO: 56236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatcatcgtctctctatagtccgggaaga

SEQ ID NO: 56237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatccaagggaagagttgtggtggatgcg

SEQ ID NO: 56238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatccagcttagtatgtgacgcggtgctt

SEQ ID NO: 56239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatcccaggtcatcgttgtagtgcggggt

SEQ ID NO: 56240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatcgaaccgtacagcctatcgtccggct

SEQ ID NO: 56241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatcgggcaacggaagaggccacttgccg

SEQ ID NO: 56242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatcggtgactcaagtaagtgcgttctgt

SEQ ID NO: 56243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatctacatcccttctaaatggtttggat

SEQ ID NO: 56244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatctggccagtcagtgctatttgatccc

SEQ ID NO: 56245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatggagtacggtgaccgatggtgatccc

SEQ ID NO: 56246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatgtgcagggagatctcccgctgcgtgt

SEQ ID NO: 56247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcattgaagtctccttgttactttgggtgg

SEQ ID NO: 56248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcattgcgctcatatgttcaagccctgtat

SEQ ID NO: 56249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcattggcgagtagttgctcttgattgtgc

SEQ ID NO: 56250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcattggctagcggtcaggtggctacatcg

SEQ ID NO: 56251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcatttcgatggactgagctttcggggtgt

SEQ ID NO: 56252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccaaatgtgggatgtaagcgcattaggta

SEQ ID NO: 56253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccaacggcagtccgttcggtgcataggtt

SEQ ID NO: 56254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccaagggagacagtgccgtcccgacgcgc

SEQ ID NO: 56255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccaagtcgtcccgcccttgccttgttgtt

SEQ ID NO: 56256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccaagtgggtagtcacgagtcgcgactct

SEQ ID NO: 56257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccaataatgggatcccgagcttatgacgt

SEQ ID NO: 56258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccaatgcgatacgttgtgccgccgcttcg

SEQ ID NO: 56259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccacacaggtaattggctcaatcattagg

SEQ ID NO: 56260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccacactgagagctatcgcagaactctac

SEQ ID NO: 56261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccaccagggctcaatgtcatccagccgtg

SEQ ID NO: 56262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccaccggcagcgtaccgacctcgatcgct

SEQ ID NO: 56263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccaccggtagctggggaatccgcgggaca

SEQ ID NO: 56264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccacctaaacgtatatcctaacggaaccc

SEQ ID NO: 56265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccacgaggggcgaacgcgagcgtttcctc

SEQ ID NO: 56266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccacgtatcggcagataaacgtcatcgtg

SEQ ID NO: 56267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccacgtttcagtcagcgtcaatgcacggc

SEQ ID NO: 56268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccactatatctgcggattacatcggcgtc

SEQ ID NO: 56269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccactcaccggtatggggatctttggagc

SEQ ID NO: 56270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccagagttcgatccggaggcggtagtcat

SEQ ID NO: 56271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccagatagccacactgggcatagataccg

SEQ ID NO: 56272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccagcctatcgaacggtccggatcacgga

SEQ ID NO: 56273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccagcctggaccatagtttccgtacacaa

SEQ ID NO: 56274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccaggagtacataacatgtcgccggcggg

SEQ ID NO: 56275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccatctcgtcaacatggtatatgtgaagg

SEQ ID NO: 56276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccatgcgcgatcaagggccgaacgcttac

SEQ ID NO: 56277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccatttcttagtatcaatcggtcatcccg

SEQ ID NO: 56278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccaagcatctattgtacaggttcgggcg

SEQ ID NO: 56279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccaataattatggaaaagctagggtggg

SEQ ID NO: 56280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccacgtgctgtaagctgctggacgtacc

SEQ ID NO: 56281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccacgtgtaaacctggcaggttcattgc

SEQ ID NO: 56282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccaggcggatggaccgacagtcgaaggg

SEQ ID NO: 56283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccatgcagaagcccccttcaggtcattg

SEQ ID NO: 56284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccattgttttggtgattagttttcgtgc

SEQ ID NO: 56285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccccagtatccataccctgccagctgtc

SEQ ID NO: 56286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccccatttcgaaagccccgtttgcttgg

SEQ ID NO: 56287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccccctattggatgtgccgggccgtacgt

SEQ ID NO: 56288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccccggagaagaggctcgttgttgtcaga

SEQ ID NO: 56289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccccggtcctggggatacatctactagca

SEQ ID NO: 56290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccgacgcttagagttggaaccggggagg

SEQ ID NO: 56291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccgagcatgctctacaccacgagtagca

SEQ ID NO: 56292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccgcggcccatacaagatgtgccacaaa

SEQ ID NO: 56293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccgctcacgccgtttggtacacggccta

SEQ ID NO: 56294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccggtgctccggaccctgtgacgctacc

SEQ ID NO: 56295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccggttcagttgctgcgcgcttttggtt

SEQ ID NO: 56296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccctgcagtgtctccggaaacgtgcggtc

SEQ ID NO: 56297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccttaatgcactgccgatattttagtcg

SEQ ID NO: 56298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccttatttgcagtttacctttgcgacca

SEQ ID NO: 56299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcccttcgtcgttgcgtccagctgcctaga

SEQ ID NO: 56300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgaagaaagagacatgagctaatgaacg

SEQ ID NO: 56301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgacacaggagctgaccaccgcagtcac

SEQ ID NO: 56302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgacacttacgtgctgatgctcatcgtc

SEQ ID NO: 56303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgacagcgggaatgcactcacatccctg

SEQ ID NO: 56304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgagttcgttcgcattagagatgggcct

SEQ ID NO: 56305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgataggtttgtccagatcgcattggtc

SEQ ID NO: 56306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgatctgtatctactagctggacgattt

SEQ ID NO: 56307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgattcttattttaagtgtccggattgt

SEQ ID NO: 56308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgcaacaatcgtctaacggttgttattt

SEQ ID NO: 56309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgccatacattgctgcaaagttagcgtt

SEQ ID NO: 56310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgcgacacaaatcgcctgacatgtacta

SEQ ID NO: 56311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgcgacatgtattaaagaaacctgcgct

SEQ ID NO: 56312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgcgtatatacgttttagagaatcggca

SEQ ID NO: 56313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgcgttattgtttgtaactaattcggcg

SEQ ID NO: 56314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgctacgtgtacaatgatcaggtagagg

SEQ ID NO: 56315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccggacggcggctaggcgtaatattatca

SEQ ID NO: 56316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccggagctatttactcaatcaatcgttcg

SEQ ID NO: 56317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccggattgtctcgtacgggaaataccatc

SEQ ID NO: 56318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccggcacgcgccatgtcaaccattgtccc

SEQ ID NO: 56319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccggcacgttatcaaggtgtggtttcgta

SEQ ID NO: 56320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgggatcacatccatcgtttcgaagctt

SEQ ID NO: 56321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgggcggtggggatggtcaagtggctgt

SEQ ID NO: 56322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccggtgcatcaacaacggactgcccttca

SEQ ID NO: 56323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccggtgctaccgaggcgaaggtggtttgt

SEQ ID NO: 56324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccggttatatgaacttagtgggaaatggt

SEQ ID NO: 56325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgtacttgctcggtttcacgttagtcaa

SEQ ID NO: 56326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgtgccctattcccctatcggccgcgga

SEQ ID NO: 56327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccgtggccgtctgttggccgtttctggag

SEQ ID NO: 56328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcctacagtccgatactcaaggcctcggtg

SEQ ID NO: 56329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcctcgctgcaggttcttactattttacca

SEQ ID NO: 56330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcctcggtatgacaggtgcgtggggcatcg

SEQ ID NO: 56331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcctcggtccacctgcttgtacgttgatcc

SEQ ID NO: 56332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcctctcgggattgaagcatcaagtactca

SEQ ID NO: 56333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcctgaatttgggtggtacggggttgggcg

SEQ ID NO: 56334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcctgcgagcggatggtattgcgcaatgcg

SEQ ID NO: 56335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcctggactccaaagattgcttacggcacg

SEQ ID NO: 56336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcctggtcatggcttgcgctatttaggttg

SEQ ID NO: 56337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccttcttctgatagttcaactgcccgccg

SEQ ID NO: 56338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgccttggtctttacgcgggcatggttatac

SEQ ID NO: 56339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcctttttaacggtgtttgtgttactgggt

SEQ ID NO: 56340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgaaaaaccgtgcaaaccccgggtgttta

SEQ ID NO: 56341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgaacagtagcgctaccttaccgcttagg

SEQ ID NO: 56342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgaagacgcccatcactagaatgtttacg

SEQ ID NO: 56343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgaagatcccaggtctttgtacctccgtg

SEQ ID NO: 56344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgaagcaaaccgtccggtgtacacacgat

SEQ ID NO: 56345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgaatcaagcagggtgtggctctaccagg

SEQ ID NO: 56346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgacaggcggcagtagtcaggatgtgcaa

SEQ ID NO: 56347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgacagtcaagtagagccgatgtttgggg

SEQ ID NO: 56348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgacatgcgcgcgggacggaggctgagcc

SEQ ID NO: 56349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgacattaatgtaggtgggtcactcgagg

SEQ ID NO: 56350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgaccctttgcctagtctgagggttggat

SEQ ID NO: 56351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgaccttcctccctaacaattagagttgc

SEQ ID NO: 56352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgacggattgcttatctgagcttgactgc

SEQ ID NO: 56353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgacggtatgcatatctcgttgggctttt

SEQ ID NO: 56354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgacgtgtaggtgacgatcgcctggtgtt

SEQ ID NO: 56355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgagaaaactgtgggttctatgtatcctt

SEQ ID NO: 56356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgagaacctggcaggcccattccacaccg

SEQ ID NO: 56357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgagacacgacagcgttcgtagccctccc

SEQ ID NO: 56358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgagcagtattcgagggacaacgcacggg

SEQ ID NO: 56359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgagccacgtcattgtcaactcctgtccg

SEQ ID NO: 56360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgagcgatccgtttaaagtatatagctaa

SEQ ID NO: 56361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgagcgttgggaaattgatgcgatcctcg

SEQ ID NO: 56362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgagcttacgttcgcctaggtggcagcct

SEQ ID NO: 56363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgaggtgaccgacggccccaacctactac

SEQ ID NO: 56364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgagtactgacacagcaccgaccgtggcg

SEQ ID NO: 56365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgataaagccgtgcgtcgttagtggcacg

SEQ ID NO: 56366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgatcacgtctcattcccgacatcattag

SEQ ID NO: 56367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgatcattcattaccatccatgtgactga

SEQ ID NO: 56368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgatcggggacgttgcgctcgtgagggct

SEQ ID NO: 56369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgatgactgcttgactctgctacgtattg

SEQ ID NO: 56370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgatgataattggttggctttcttccgct

SEQ ID NO: 56371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgatgtagtctcggcctacacttgatatg

SEQ ID NO: 56372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgatgtcaggagcaaaaaattagcaacta

SEQ ID NO: 56373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcaaccttttgtatgtcggggctatgtc

SEQ ID NO: 56374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcaccagataggtcatgagtgtgtggaa

SEQ ID NO: 56375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcagacattgatggtcagaagagacggt

SEQ ID NO: 56376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcagctcggctttctcctgctttatacc

SEQ ID NO: 56377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcagttattttgttcatcttgccaccgg

SEQ ID NO: 56378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcatgagtgtcatcgggcccgtgaattg

SEQ ID NO: 56379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgccaccagcaagtagcggtgatacagat

SEQ ID NO: 56380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgccatgcgagtttcagtgtccgaactaa

SEQ ID NO: 56381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgccgaatgacggatttcattctcacgcc

SEQ ID NO: 56382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgccgctttttgttgggacatcttgtata

SEQ ID NO: 56383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcgaagtggttatacatatcctgcttat

SEQ ID NO: 56384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcgagatatatgtgaccaacgcaagtcg

SEQ ID NO: 56385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcgccagtacaacgcaatcttggtgtct

SEQ ID NO: 56386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcgcttgtgtaaatacatcaacaccctt

SEQ ID NO: 56387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcgggagtacccgatggcgtctggtacg

SEQ ID NO: 56388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcgtatatagttctacggtcgcagctgt

SEQ ID NO: 56389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgctaagctctccaaagggtgcatcgctt

SEQ ID NO: 56390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgctagggttgttagtcatgggtggctgt

SEQ ID NO: 56391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgctatgtccgcaagtctgagggtatgcc

SEQ ID NO: 56392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgctcgaatggtgccggccgtgaaacccg

SEQ ID NO: 56393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgctctcaacaccgagcctcggaccgtgt

SEQ ID NO: 56394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgctgataagtagacgaatgcatcaagga

SEQ ID NO: 56395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcttagataaatgtgtgattggcggccc

SEQ ID NO: 56396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgcttgtactctaagagggcgtttgaccg

SEQ ID NO: 56397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgctttttaccgtggacatattttcctca

SEQ ID NO: 56398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggaaacgtggtatagaaatctttgtcca

SEQ ID NO: 56399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggaaggcagcggggttataacgtatggt

SEQ ID NO: 56400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggaatctagcgatgcggttgggtggcct

SEQ ID NO: 56401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggaatgtactcggatatggatcggaggt

SEQ ID NO: 56402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggacctgacacgcagtttattccggcgc

SEQ ID NO: 56403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggactgctcggggtaccttcgggtcacg

SEQ ID NO: 56404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggatcccaatcgcgtcggtctcgactag

SEQ ID NO: 56405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggatcgacgatgtcatgtgtctttggcg

SEQ ID NO: 56406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggatggactcgctgacctccgggggcct

SEQ ID NO: 56407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggcacagtatcgtaacggcattcaagtc

SEQ ID NO: 56408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggcaggagacgggggtaccacgttggct

SEQ ID NO: 56409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggccaggaggtcagttggtggtcggtga

SEQ ID NO: 56410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggcctcaccgggcgggttagaacgagtg

SEQ ID NO: 56411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggcgaaatgctacccggcattgttgaag

SEQ ID NO: 56412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggcgagtgtacagggcatcgagacggcg

SEQ ID NO: 56413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggcggcgggaatggaaggatacagcgtt

SEQ ID NO: 56414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggcgggtacactgttgctgttaccttct

SEQ ID NO: 56415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggcgtttccttagcgccttcgtgatcca

SEQ ID NO: 56416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggctcgcatcgcttgaacgaaacacggg

SEQ ID NO: 56417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggctctagtgaacgttgcgttcccgcgt

SEQ ID NO: 56418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgggaccccttcgttcgaggtgaagcggc

SEQ ID NO: 56419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgggacgtcttgaaagacaggggccggtc

SEQ ID NO: 56420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgggagcgtgctcttacgctggatctcct

SEQ ID NO: 56421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgggatattgacggtggctagatgggtgg

SEQ ID NO: 56422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgggcaaatgttggtagggccgggtcgtc

SEQ ID NO: 56423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgggggatcccggagctgagtgtcaaacg

SEQ ID NO: 56424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggggttaatgggaggcagccagcagcga

SEQ ID NO: 56425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgggtcgagatgattgcagccggctcaac

SEQ ID NO: 56426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgggtgcgagatgggtgtgtctctcatat

SEQ ID NO: 56427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgggttatagcgcggtttcgaggttcagt

SEQ ID NO: 56428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggtacctaattgctgcgcctgcctagtc

SEQ ID NO: 56429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggtacgccgatatcttttttgctgtgct

SEQ ID NO: 56430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggtaggtacaaaatgatccttaactctt

SEQ ID NO: 56431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggtcaacacggagatccgtcaggggttg

SEQ ID NO: 56432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggtcatggcgtgagtcactaagctagcg

SEQ ID NO: 56433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggtcccttcacctttaaatactgggcgc

SEQ ID NO: 56434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggtcgttcagtggcatctctctgtcatt

SEQ ID NO: 56435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggtgaccttgaaacccaaatcgtgatga

SEQ ID NO: 56436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggtgattggcttgttactctagtccgcc

SEQ ID NO: 56437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggtggccgattcgacagttgagagcgga

SEQ ID NO: 56438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggtgtgagtcaactaagtcggctcattc

SEQ ID NO: 56439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcggttagtagagacattttgcgttcctaa

SEQ ID NO: 56440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtaaaaggaatcgcggccgtgccggggt

SEQ ID NO: 56441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtaagagcaggcatgcatgcggcaacac

SEQ ID NO: 56442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtaagtcaacggtatgcaagtttgccgt

SEQ ID NO: 56443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtacgcagtgtgtgtcatgaccgttgct

SEQ ID NO: 56444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtaggcgggtcagggtttgtcctacacg

SEQ ID NO: 56445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtagggaatcggctgatggaagtcttgg

SEQ ID NO: 56446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtcaccgctgttccggcttagatgtttc

SEQ ID NO: 56447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtcccaccattgtgtctctgcgggcgtc

SEQ ID NO: 56448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtcccagtctgaggggcttccacctgca

SEQ ID NO: 56449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtcctgccataggtgcaggatcctgtca

SEQ ID NO: 56450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtcttgcacagtgctggctattatgcgg

SEQ ID NO: 56451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtgaccacgcgagagccggatgaactgg

SEQ ID NO: 56452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtgaggtcccgtcacggcgctcgttccc

SEQ ID NO: 56453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtgcataatgggagggacgagtaaagga

SEQ ID NO: 56454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtgcgcgaaggatactaactgggatgcg

SEQ ID NO: 56455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtgcttactgacgcagtacatttgtccc

SEQ ID NO: 56456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtggaaaggacaccagataatttttcac

SEQ ID NO: 56457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtgggcattgtagcgacagcgtcatccc

SEQ ID NO: 56458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtgtacttataatcgtgcgtcgggttat

SEQ ID NO: 56459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtgtcaagattatttacggcgacccggg

SEQ ID NO: 56460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtgtgggttcgtggaaagcgtgcacccc

SEQ ID NO: 56461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtgttaggtgaaaggccactgttagacg

SEQ ID NO: 56462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgttcaaagtggggtgggttaatgtgttg

SEQ ID NO: 56463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgttggtcttgtgaggtttatggcagttg

SEQ ID NO: 56464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcgtttcagctcagatgcgtcgggcgaccg

SEQ ID NO: 56465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctaacatgctcattttcgcagcgcaagtg

SEQ ID NO: 56466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctacaacgcatagctgtgaggcgatcgtt

SEQ ID NO: 56467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctacacattgtacaaaggttgtaataccg

SEQ ID NO: 56468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctacatgacagcctgaggagcgattgact

SEQ ID NO: 56469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctacatttatattgcgtaccttcagcccc

SEQ ID NO: 56470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctacgctgattcggttgcaagggcctgcg

SEQ ID NO: 56471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctactaagtaaaccttacgcggcaccttc

SEQ ID NO: 56472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctactgggggaccatgccatttagtacgt

SEQ ID NO: 56473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctagccttatggttccgcgggttacggca

SEQ ID NO: 56474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctagcttggaggaggctcttcgttatggc

SEQ ID NO: 56475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctagtcaactcgccttctactttattatc

SEQ ID NO: 56476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctagtgctaacaataaaggccacagtgat

SEQ ID NO: 56477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctatcaagggcccctaatcgcatgcatgg

SEQ ID NO: 56478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctatcaatgctatcatggtaggcactttg

SEQ ID NO: 56479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctatcgtcaaataggtggctctgggttct

SEQ ID NO: 56480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcagtactgaacttggagtgggggtcca

SEQ ID NO: 56481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcatgtggcggagggggttggggccgcg

SEQ ID NO: 56482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctccacttagggtcggagattttatcacc

SEQ ID NO: 56483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcccgcgtgagttcattagtggctgctc

SEQ ID NO: 56484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcccttgttcatgatcctttcttgccca

SEQ ID NO: 56485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctccggaatgacccacgtctctgatttct

SEQ ID NO: 56486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcctctgtaaacgcaacagggaagggtg

SEQ ID NO: 56487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcgacggttcttggcttctacggagctt

SEQ ID NO: 56488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcgactagccggccagctgacgcagtat

SEQ ID NO: 56489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcgcaagtctgttttgggtcatcagtcg

SEQ ID NO: 56490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcgcctctggaccaaggacttatgagcg

SEQ ID NO: 56491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcgcgatttggaggtcgggtggcacagg

SEQ ID NO: 56492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcgtgcggcacaacggagaggagtaggc

SEQ ID NO: 56493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcgtggtaccgtttcgattcgaagagtg

SEQ ID NO: 56494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcgttggtgtcgaatataggtagatacg

SEQ ID NO: 56495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctctcagaacgtcgcacgtgtgaagtatc

SEQ ID NO: 56496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctctccgtataagcgtgttgatgtgcttg

SEQ ID NO: 56497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctctcgggcgaagtagacaagttccacgt

SEQ ID NO: 56498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctctggggaatcgtcacatgggcggattt

SEQ ID NO: 56499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctcttgacggtgcgagggatgattcggcc

SEQ ID NO: 56500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgaaacgcgggcatgtcattccatgtag

SEQ ID NO: 56501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgaacactgggtgcccgtcgttgtggac

SEQ ID NO: 56502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgactctcaattcaccgtcttgtagccc

SEQ ID NO: 56503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgagcggttcggatgtataggcgcatac

SEQ ID NO: 56504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgaggggctcaggagtgggattggtgtt

SEQ ID NO: 56505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgagtagacggggcatcgtggttataca

SEQ ID NO: 56506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgatatggaaacagctagttattatcgg

SEQ ID NO: 56507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgatttcctgttcgacccgttgacaact

SEQ ID NO: 56508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgcataactgttgtgtctctttggttgt

SEQ ID NO: 56509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgcgagaaagtataagaacggtcggacg

SEQ ID NO: 56510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgcgggtggatccgctggtagctactcc

SEQ ID NO: 56511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgctgacctccgttaaacgttaatatgc

SEQ ID NO: 56512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgcttgcaatgggtcctcagggagactc

SEQ ID NO: 56513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctggattgtcaagctgagcgtcgcattcg

SEQ ID NO: 56514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctggcgggtactgtgttcattttacaggg

SEQ ID NO: 56515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgggacgacgacgaaagctacctcgtac

SEQ ID NO: 56516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgggccgccattgtttgtgcgcatatat

SEQ ID NO: 56517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctggtcatactttcttccctcgttatggc

SEQ ID NO: 56518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctggttctttcgtttaccttgcggcgcgt

SEQ ID NO: 56519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctggttgttgagattcagggttgatgtga

SEQ ID NO: 56520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgtacatcttgtttgattgtgcggagtg

SEQ ID NO: 56521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgtatgccgggtaagctaatcggggacc

SEQ ID NO: 56522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgtcctttgctatgcgactggtttgtga

SEQ ID NO: 56523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctgtctgcttgaaacaagacgcgtgttgt

SEQ ID NO: 56524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttaccctcggttctggtagagcggtctc

SEQ ID NO: 56525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttactgatgcctactttaattgtactcc

SEQ ID NO: 56526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttagcggaggtcgcctgacgtatctgct

SEQ ID NO: 56527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttatggcctcacacgcaatcacctgctc

SEQ ID NO: 56528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttattccgcgttagctcacagtcgagtc

SEQ ID NO: 56529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttcagactcatatatcggctcctctagc

SEQ ID NO: 56530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttcctgcagatctgctgttgtcggttgg

SEQ ID NO: 56531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttcgccaagtacctaatccgctcgatgt

SEQ ID NO: 56532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttcgcgatcttggagaaggggtccggtg

SEQ ID NO: 56533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttctgacgctgggaaggactaggttcgt

SEQ ID NO: 56534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttgaatggaggaggtggggattggactg

SEQ ID NO: 56535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttgccgatgatctccagcccgccagatg

SEQ ID NO: 56536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttgcgaatcggttagtccactcctacgc

SEQ ID NO: 56537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttgctcgaccggcgagtggtgtgctgca

SEQ ID NO: 56538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttggctcgcccaagtcattgctcacgtc

SEQ ID NO: 56539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttggggcctatttcattcgggtttatcc

SEQ ID NO: 56540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttgggtgctcctgatgtactctgtctta

SEQ ID NO: 56541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttggtagaggctgctcctgggacctacg

SEQ ID NO: 56542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttgtatgccgctgctttagccatatcac

SEQ ID NO: 56543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctttaccgatctacgagtagtccttcgtt

SEQ ID NO: 56544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctttagtggcactggcccgtctgatctgg

SEQ ID NO: 56545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctttcacgggccgtgaccgcttatgcctg

SEQ ID NO: 56546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctttccatgttgttacccaattaggctat

SEQ ID NO: 56547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctttcggtatgcagcgcgtctctctgtaa

SEQ ID NO: 56548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctttgaatgttaaaccgtcacgtatcact

SEQ ID NO: 56549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgctttgtgtcgcggagactgcgctgtgaag

SEQ ID NO: 56550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgcttttctcatttggagacgtgtgtctaac

SEQ ID NO: 56551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaaagaggtgtttaagtcatgtgcaatgc

SEQ ID NO: 56552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaaagcacattccgttcgtttggtgcgcg

SEQ ID NO: 56553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaaagccacaaatgatgctcccgtcggat

SEQ ID NO: 56554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaacaagcgtctgggttatgtttatgttt

SEQ ID NO: 56555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaaccacgttgagcgttgacttcgtcctt

SEQ ID NO: 56556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaacgagtactaggggctgttatccatcg

SEQ ID NO: 56557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaacgcgacggcacgctctcgacgggcat

SEQ ID NO: 56558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaacgctaaaaagcacgctccttgttgtt

SEQ ID NO: 56559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaacggctgagtcactgagcatggcatcg

SEQ ID NO: 56560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaacgttttctggattactcgatggggct

SEQ ID NO: 56561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaactcgtgtcgtcctgacggaaaagctg

SEQ ID NO: 56562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaactgcatcggtgcgtgcagctgcctta

SEQ ID NO: 56563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaagagctggtgaagcggatatactgaag

SEQ ID NO: 56564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaaggccgttgtgcagggctaatttcagt

SEQ ID NO: 56565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaagggacaaagtggcaaccggcgaattt

SEQ ID NO: 56566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaagggctcgttcgtctccccgtgtatct

SEQ ID NO: 56567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaataccatgcgcgtacacggcattgacc

SEQ ID NO: 56568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaataggttgggtaacaggcacgtttatg

SEQ ID NO: 56569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaatcatgaaacccccgatcatgtaccga

SEQ ID NO: 56570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaattgatggttatgcttttacatatagt

SEQ ID NO: 56571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacaaggggcgagatgtgctagggcacgg

SEQ ID NO: 56572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacaagtcacgggtctgccggtattaggg

SEQ ID NO: 56573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacacccggtggattggacacaacggatc

SEQ ID NO: 56574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacacggctcggacttggactgcgaatgc

SEQ ID NO: 56575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacagagttactgtagtcagctcattttg

SEQ ID NO: 56576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacagctcagttaccggtgtagaggtgcg

SEQ ID NO: 56577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacaggactcggacgcctcgtgacaatta

SEQ ID NO: 56578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacagtcactgtaggagactgatgttacc

SEQ ID NO: 56579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacatgtcgtttaggaatcgcaccacctc

SEQ ID NO: 56580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacatttgacgacaggctcgcattccgtg

SEQ ID NO: 56581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacccaagtcatgttgggcgtttgaggga

SEQ ID NO: 56582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaccggagtacagtgttggcgagtgctgg

SEQ ID NO: 56583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaccggttggtaaatggatacagtatata

SEQ ID NO: 56584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacctgcagaatttgtactttgcagttag

SEQ ID NO: 56585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacgatcgtgggtgtacgaaccaaatagg

SEQ ID NO: 56586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggacggttctttgctatatacttgggacac

SEQ ID NO: 56587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggactattcaaacatcctcttgggcaaagg

SEQ ID NO: 56588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggactatttgtacttgtgctgtaccgtcgc

SEQ ID NO: 56589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggactcacatattattacggcattcggggc

SEQ ID NO: 56590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggactccactacggagaagaaggtaatttg

SEQ ID NO: 56591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggactcggcgcggtaaacaagttgctggtc

SEQ ID NO: 56592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagaagtgtatggaacaactcccgatggg

SEQ ID NO: 56593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagattatgaatgcatctggcggactggg

SEQ ID NO: 56594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagcagatgaacgtcatccaatgaggggg

SEQ ID NO: 56595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagcagtgacacggctcgtatatgcgcca

SEQ ID NO: 56596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagcccgacccaccagtttgtctcgtctc

SEQ ID NO: 56597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagccgggactgagtgggatggacggcgg

SEQ ID NO: 56598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagcctcgatgaccccctgccttgcatgt

SEQ ID NO: 56599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagcgcgaagttgatgagtaagtttgggg

SEQ ID NO: 56600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagcggaagcaagaacaatctaggttagt

SEQ ID NO: 56601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagcggtttgcggaatggcggtcgtgctc

SEQ ID NO: 56602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaggaactccagaccaattctgatcccgc

SEQ ID NO: 56603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaggagtgtaggtggggcggctgtttacg

SEQ ID NO: 56604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaggatggcgcgatgcctgtttaagctca

SEQ ID NO: 56605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaggcctatcaattccgcacaggctatac

SEQ ID NO: 56606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaggcctgtgggactgggacatcggtccg

SEQ ID NO: 56607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaggcgagatagtcgatattgcaggggtg

SEQ ID NO: 56608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaggcgctttaaacaccgggctcacttgc

SEQ ID NO: 56609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaggctaactggggtgctggtacgaactc

SEQ ID NO: 56610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaggctttaatgggaaatggaacaaaaga

SEQ ID NO: 56611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggaggcttttctttaagtttgactgctgtt

SEQ ID NO: 56612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagggatgtgggtgcgaatttttacggat

SEQ ID NO: 56613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagggcagtgggcgcgtatggtctggtgt

SEQ ID NO: 56614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagggcggcaagtggactggacctaggcg

SEQ ID NO: 56615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagtatgggcggtaaatcttcgccaatgg

SEQ ID NO: 56616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagttgtacgggcgattgatgttagcgtg

SEQ ID NO: 56617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggagttttcgcgccgttaaagcatatccta

SEQ ID NO: 56618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggatagccgatgtatgggttttccttcatt

SEQ ID NO: 56619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggatatcaggtatctcagcgcagaagttag

SEQ ID NO: 56620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggatattatttacccgtggtagtccttaag

SEQ ID NO: 56621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggatcgttgcgttttagcgtggaggcggcg

SEQ ID NO: 56622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggatcttaggctgctcttcgcggatctgtg

SEQ ID NO: 56623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggatgacttggtggggttcgccccgggaga

SEQ ID NO: 56624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggatggaggaacgcgtggttcggcctgact

SEQ ID NO: 56625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggatgttggcttgatgaaggcatggctggc

SEQ ID NO: 56626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggattagcacttataacccaacgcctataa

SEQ ID NO: 56627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggattatgaatctccttttcattgtgcgta

SEQ ID NO: 56628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggatttcaatgctcgcactgcattcgcccc

SEQ ID NO: 56629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcaaacgtttcgtcgggcatttgcgacgg

SEQ ID NO: 56630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcaacgtcggtcattgcgtcgacgtccct

SEQ ID NO: 56631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcaatcgcccgcacctgcgaatgggctca

SEQ ID NO: 56632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcacacaccgattgactcagtatgacgcg

SEQ ID NO: 56633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcacaggcagtgactgggcaacttcctcg

SEQ ID NO: 56634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcacaggttgacacgaggagctgttaagg

SEQ ID NO: 56635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcaccaaggcttacttgacaatacggtcg

SEQ ID NO: 56636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcacgcagacataagggactgaacggggc

SEQ ID NO: 56637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcacggtgcgatgtactaacacagtgtgg

SEQ ID NO: 56638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcacgtgatagagtggctcacttcgatgt

SEQ ID NO: 56639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcactcggttaggtccaagaatgcctccg

SEQ ID NO: 56640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcagagaggctcgatagaccgtaaggtgg

SEQ ID NO: 56641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcagcttgctctcagcgtgtctctatccg

SEQ ID NO: 56642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcaggaacaagatgccattcgggcgccga

SEQ ID NO: 56643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcagtaacggaatacgacgcggacagtgg

SEQ ID NO: 56644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcatacatcccttactacttagctgcggt

SEQ ID NO: 56645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcatagaattcttttttatcaatggttcg

SEQ ID NO: 56646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcatcagcgtgggccagcgtgtttttctc

SEQ ID NO: 56647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcatctaacagcgatagcccctctgtcta

SEQ ID NO: 56648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcatgaatcgatcgtgtatgattcctcct

SEQ ID NO: 56649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcatggaatcacgcatggcctgagagacc

SEQ ID NO: 56650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcatggcacgggacaaacggtagggcgtg

SEQ ID NO: 56651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcatggtgcgttgtgaagaaaactacatc

SEQ ID NO: 56652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccaacaaggggcattggctgggcatgtt

SEQ ID NO: 56653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccaatcgcgctcatgctttgttgcagtt

SEQ ID NO: 56654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccaatcggtggtgtttcagtccatacat

SEQ ID NO: 56655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccaccgggcaatcgtccgtcacttcaga

SEQ ID NO: 56656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccacgacagaatggaacgagtgtgcgaa

SEQ ID NO: 56657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccactgtaaacttggatttccttacggg

SEQ ID NO: 56658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccacttcgattgaccttacgtcactccc

SEQ ID NO: 56659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccagactcgcaaaggcagcgggtaggtc

SEQ ID NO: 56660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccataccaggaatcaactgcattcgtgg

SEQ ID NO: 56661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccataccgtcgttaacaattctcaacac

SEQ ID NO: 56662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccatcgaagggcgactatcctggcgaca

SEQ ID NO: 56663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccatcgcaatctggggggagtggggtac

SEQ ID NO: 56664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccatgattgtttcaactacgaatgtgct

SEQ ID NO: 56665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccatgcggtgtgagcgttagggactcgc

SEQ ID NO: 56666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcccaacaatcgtcaacgggcggcgaggc

SEQ ID NO: 56667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcccaacggtactcagcttgcccagttgt

SEQ ID NO: 56668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcccatgcgttcctggagggcttgagccg

SEQ ID NO: 56669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccgaacgtcgagcagagtctatgccttg

SEQ ID NO: 56670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccgaatggtttcacagtttggggactca

SEQ ID NO: 56671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccgagccgtgcataacgcctctcatgtt

SEQ ID NO: 56672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccgatgtgtagcctcgacaagggtcggc

SEQ ID NO: 56673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccgatgttccgcttacagtccgtgggtt

SEQ ID NO: 56674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccgcatgtgtatcggtggtagttaggga

SEQ ID NO: 56675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccggaaggatagattcttgttatggacc

SEQ ID NO: 56676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccggctccggaggcttttaagtagattg

SEQ ID NO: 56677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccggtcaaacttgtccgttcgcgttcgg

SEQ ID NO: 56678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggccgtactattctgtcaactttgccgtgc

SEQ ID NO: 56679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcctgagggatgataacccaatcttaggc

SEQ ID NO: 56680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcctgggtcagcagcacggtgttatcgca

SEQ ID NO: 56681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgaagtgtgggtgtcaccgtgcattagg

SEQ ID NO: 56682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgacaaacatcgctgctatcgggtgaac

SEQ ID NO: 56683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgacattccgatcgtctagccgttactg

SEQ ID NO: 56684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgacccgacagcgatgtggaagataagc

SEQ ID NO: 56685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgacttaggagccatcactatgttgtac

SEQ ID NO: 56686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgagacgcgtgaaggtccaacatgtggc

SEQ ID NO: 56687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgagtgttatgagctgcgggacaccatt

SEQ ID NO: 56688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgatacgaaccatacgtatggcagttcg

SEQ ID NO: 56689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgatcaggtgggacgtcggattatggac

SEQ ID NO: 56690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgattcaggtccattgaatcaaggattg

SEQ ID NO: 56691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgcaatgtgggggtgtgctgcaatatcg

SEQ ID NO: 56692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgcacgtatcattcgcggggtttggtgt

SEQ ID NO: 56693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgcatccactttgtgcaaattcattttt

SEQ ID NO: 56694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgcgcggttcgctgcacgtagtctcaaa

SEQ ID NO: 56695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgcgtatagaagagcagcgactgacaca

SEQ ID NO: 56696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgcgtcaagctgccagtcttccgtttcc

SEQ ID NO: 56697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgctactgagtttacgatcatgtcgaat

SEQ ID NO: 56698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcggaagttcccttgacaagtgccatggt

SEQ ID NO: 56699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcggagctcattgttggctttccctgtat

SEQ ID NO: 56700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcggccaatcaacgatttacgtcgcgtcc

SEQ ID NO: 56701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcggccagccagctcgtgtcgtgggagta

SEQ ID NO: 56702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcggccatgcctgtccttatcatggagct

SEQ ID NO: 56703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcggcccctacatgtacgtcgcttgcagg

SEQ ID NO: 56704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcggcggacacatgttgcataagtggtat

SEQ ID NO: 56705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcggctgtcatatgtccgcatgggacgat

SEQ ID NO: 56706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcggtaaggtgaggttgtatccgtggtcc

SEQ ID NO: 56707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcggtgcactgtgtacggtcgcatggtcc

SEQ ID NO: 56708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcggttattatgtctcaagtgcggtggcc

SEQ ID NO: 56709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgtccgggaaactgaaagcctcatgggt

SEQ ID NO: 56710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgtcctgttgcacgtttgacgaggagcg

SEQ ID NO: 56711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgtcgcgttgtcaggagtgggcaagtat

SEQ ID NO: 56712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgtctaatgtacaggagacttgcactat

SEQ ID NO: 56713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgtctggtgttccctggcataactcgga

SEQ ID NO: 56714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgtgagaggaaatcccacgtttgatggt

SEQ ID NO: 56715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgtggaaaggaccgcccagctccccgcg

SEQ ID NO: 56716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgtgtcgtgttgtgtacgcaggcgggcg

SEQ ID NO: 56717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcgtgtgaggcgaatctagcgcacccgcc

SEQ ID NO: 56718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctaactggaaacctagatatggaatccg

SEQ ID NO: 56719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctataggtcagggactttctacactcct

SEQ ID NO: 56720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctcaaattaagacggacgccttctagct

SEQ ID NO: 56721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctcagggaggcgtgattcagtgccgggg

SEQ ID NO: 56722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctcatgaaaacttaattccgttacattt

SEQ ID NO: 56723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctcccgtctagtgcctgttgcttttaac

SEQ ID NO: 56724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctcctgtttccgtgagatccggacgtag

SEQ ID NO: 56725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctctcggatagtcgcaagatcgcccgtg

SEQ ID NO: 56726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctgaagagcctaagcgggaagatttgga

SEQ ID NO: 56727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctgcacgcagagatcatcgaaggatcaa

SEQ ID NO: 56728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctgcttttaagttctgccgccgacccac

SEQ ID NO: 56729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctgggctatgtcggaaccacttgggctc

SEQ ID NO: 56730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctgggggagacacggcccgtccatggat

SEQ ID NO: 56731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctgttacaatgtggcgggataacgtacc

SEQ ID NO: 56732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggctgttatgtggggcaaatacacatctag

SEQ ID NO: 56733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcttgacacgtgcgttagcgttattgtag

SEQ ID NO: 56734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcttgactgcagtggcgatctcgtggtgc

SEQ ID NO: 56735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggcttgagcagtaatagagactacagttcg

SEQ ID NO: 56736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggaaactcatgactcgggtgcaacggtac

SEQ ID NO: 56737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggaaagcgtgagatccgtacaattaaatc

SEQ ID NO: 56738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggaaccgaacagaggtgtgctgacaggtg

SEQ ID NO: 56739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggaagtgttaacaactaggcggcgtctgt

SEQ ID NO: 56740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggacaacatgacggcgtgttacctggtgt

SEQ ID NO: 56741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggacacttttgggagcaagctttggcctt

SEQ ID NO: 56742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggacagaggggacaagctgagatatcgtg

SEQ ID NO: 56743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggaccaggatgttgcaggtgcggtcacat

SEQ ID NO: 56744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggaccggttccatactctgtactatggat

SEQ ID NO: 56745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggaccttccctcttttcctacggggagcc

SEQ ID NO: 56746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggacgaccaatgctcagtgcagcaaggcg

SEQ ID NO: 56747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggacgccagccgcgtgggttacctgaggg

SEQ ID NO: 56748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggacggtgaaggggcggccggtgtccgat

SEQ ID NO: 56749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggactaatacggtcacctagatgaagctc

SEQ ID NO: 56750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggagcaaaacggggagccggagtcgggcg

SEQ ID NO: 56751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggagccaatcatgtcatccctggaagttc

SEQ ID NO: 56752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggagccccgcggatccgcgagtagtgtcg

SEQ ID NO: 56753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggagcgccagcctctgacgcaagagcccg

SEQ ID NO: 56754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggaggaggacacaaagggatcgacaactc

SEQ ID NO: 56755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggaggtgtcaccgtcgggtatcaattagc

SEQ ID NO: 56756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggatccggtcggatattcgggattgtatg

SEQ ID NO: 56757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggattgcgactgcacacactttgctcggg

SEQ ID NO: 56758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggattggcggtgaacaaccgtttacattt

SEQ ID NO: 56759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcaaaagagacccttcagatgagcccca

SEQ ID NO: 56760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcaacatcatgtagcggactgcgcaact

SEQ ID NO: 56761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcaagaggcatcatggatccgtttgagc

SEQ ID NO: 56762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcaagcgtagcttgcgggacgacggagg

SEQ ID NO: 56763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcaaggactgagacgataccacacttga

SEQ ID NO: 56764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcacacgctggtcgatacacggacaacg

SEQ ID NO: 56765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcacggagcgtccagtgaaggtgagtcc

SEQ ID NO: 56766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcacgtgaccggagaaaccgcgttactt

SEQ ID NO: 56767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcatctaatgatccgcgttcctttcggc

SEQ ID NO: 56768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcatgcgtacatggaggcggcacggttc

SEQ ID NO: 56769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggccatgttgctttgacggtatggtgtga

SEQ ID NO: 56770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcccctgcgttctttcacctgatgcggt

SEQ ID NO: 56771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggccgcactcatctggctcatatctctct

SEQ ID NO: 56772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggccgtccttaaacgtgaggcagtgtctc

SEQ ID NO: 56773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcctgccgtgagttgcgcgagctagggc

SEQ ID NO: 56774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcctgtgaacgtgttcttgcattcccta

SEQ ID NO: 56775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcgaacagcggccagtcttgctacatgg

SEQ ID NO: 56776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcgaagtgtttttggatggacgctccga

SEQ ID NO: 56777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcgataaggcgcgcgttaccatcggtgt

SEQ ID NO: 56778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcgcgataggttccattggttacgcgtt

SEQ ID NO: 56779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcggctgaggctaatatgtggcctgcgg

SEQ ID NO: 56780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcggtcgggcttacgacaaaagcgtgcc

SEQ ID NO: 56781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcgtgttggcgcaactcaacgcgtacgg

SEQ ID NO: 56782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggctaaatgatcgtaaactttcaggcgtg

SEQ ID NO: 56783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggctctgagacttgacaaagtattccccg

SEQ ID NO: 56784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggctggggactaatacgcaacttgtgccg

SEQ ID NO: 56785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggctgtgctttaagctccaacactgacat

SEQ ID NO: 56786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggcttaacagtggcaggactccgggggta

SEQ ID NO: 56787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggacaactttaatcgaactgcgcacttc

SEQ ID NO: 56788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggacagttttataaccattgacgtttgg

SEQ ID NO: 56789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggacgggtagtggaacatccactccgca

SEQ ID NO: 56790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggagataactgcgccttcccgttccgtg

SEQ ID NO: 56791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggaggaaggcaattctcttagcggcccg

SEQ ID NO: 56792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggagggacgactgtccgtatcgcggttc

SEQ ID NO: 56793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggatattggggaatcgtttatactatcg

SEQ ID NO: 56794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggatgtactcttcttgacaaggcggtac

SEQ ID NO: 56795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggcaggatggacccacgtcagtgatgcg

SEQ ID NO: 56796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggccaagcgcttaaaggcgtaggggtgt

SEQ ID NO: 56797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggccagtacacctcatttggagggcgtc

SEQ ID NO: 56798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggccatttccagaattgcgtctctaatc

SEQ ID NO: 56799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggcccgcggaatggcagtgtaaatgtcc

SEQ ID NO: 56800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggcgcgtaatcggtagtcgtccaaaggg

SEQ ID NO: 56801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggcgttacgagttgggagttctgaccgg

SEQ ID NO: 56802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggcttgaactcggcttggtgtcgcctgg

SEQ ID NO: 56803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggggactgttgacgggtgatcaaaggttt

SEQ ID NO: 56804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggggctgtacctgctcggggaaagtaacg

SEQ ID NO: 56805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggggggcgttggagtaggtcgccgttggg

SEQ ID NO: 56806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggggggtccttggcgtgtgtaaaggcaat

SEQ ID NO: 56807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggggtcgattcctgcgcagcctcccgac

SEQ ID NO: 56808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggggtcgcttagtttatcactgattctcc

SEQ ID NO: 56809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggggtctccgtatgctagtaatagtttac

SEQ ID NO: 56810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggggtggagatcgcactatcgctcggttc

SEQ ID NO: 56811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggtacggtcaatcattaggccgatattg

SEQ ID NO: 56812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggtgatccgtgtgtcaagaaaggtatgc

SEQ ID NO: 56813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggtgcggtggaccgtgatcgtcaactgc

SEQ ID NO: 56814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggtggacctgagacctaggttgccgttg

SEQ ID NO: 56815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggtggggcatgtctgttccccctctcgt

SEQ ID NO: 56816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggttatcgggcaatcagtgtaggggttt

SEQ ID NO: 56817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggggttctgggtacgtctggctagttgatc

SEQ ID NO: 56818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtatggaggatagcggagccaaccccca

SEQ ID NO: 56819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtattggtgcgtttcaaattctagatga

SEQ ID NO: 56820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtcaatagatatgagtgaatcaggacga

SEQ ID NO: 56821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtcataccaccgcgtctcgagccccggc

SEQ ID NO: 56822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtcgctgactaggaacctgcaagtggaa

SEQ ID NO: 56823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtcgggaatacaccgctattggcatgtc

SEQ ID NO: 56824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtctggaccccatattgattcacaacta

SEQ ID NO: 56825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtgccgtcaggttttcccgcaaagttga

SEQ ID NO: 56826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtgctaacggggggcaggtttaggcagt

SEQ ID NO: 56827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtgggactagtgtagtttggagcccggt

SEQ ID NO: 56828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtggtgggcgaacgtagttagtgaatcg

SEQ ID NO: 56829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtgtagatcgacgggctctactcggtgg

SEQ ID NO: 56830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggttccagaattgtagggtgttcaacgtt

SEQ ID NO: 56831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggttctcgtaggcgtctgcgagagggagc

SEQ ID NO: 56832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggttgcttccgattctctgtctcgatagc

SEQ ID NO: 56833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgggtttgaaacatgtaaaagtcttcattac

SEQ ID NO: 56834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtaaaccgctcaagatcctgtgagagaca

SEQ ID NO: 56835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtaaactgatgaccgttgtccaactggcg

SEQ ID NO: 56836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtaaaggcagcatgtcgactacatcctgt

SEQ ID NO: 56837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtaacaagtgctgggtggatctttatgcc

SEQ ID NO: 56838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtaactagctttgtgaagtcgggaggcca

SEQ ID NO: 56839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtaatggtcagggttgccgcggtcggggc

SEQ ID NO: 56840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtacaatctggggtgcagtaaaccttccc

SEQ ID NO: 56841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtacacgtcaattaatacggcgtcacaaa

SEQ ID NO: 56842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtaccgacagcctcgccaaggcttatatc

SEQ ID NO: 56843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtacgtccgggtgagcttagcgtcattcg

SEQ ID NO: 56844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtacgttgagatgggatggtctgatggga

SEQ ID NO: 56845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtactggactctgttagcgactgcacatc

SEQ ID NO: 56846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtacttatctcctttctaacgagagtgtt

SEQ ID NO: 56847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtagacttagtggaagggcacagtcgacc

SEQ ID NO: 56848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtagatccctgaagcacgagtatgtcgcg

SEQ ID NO: 56849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtagcgcccggttacgaccgtgccgtggt

SEQ ID NO: 56850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtaggatggaggccacgtggacaaactct

SEQ ID NO: 56851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtaggtcatgctcgtagtaggcgaatgac

SEQ ID NO: 56852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtaggtcgggtctacgtttcccacttttg

SEQ ID NO: 56853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtagtagactgatcctctgatttagtgcc

SEQ ID NO: 56854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtataatggccctcggtaatcaggtgtat

SEQ ID NO: 56855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtatggggggaactgtggcgtcgtgcaga

SEQ ID NO: 56856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtatggtttttgtacggccagtcgaatca

SEQ ID NO: 56857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtcactctaattgctgagggatcatgacg

SEQ ID NO: 56858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtcagcttattgttgtgtaatgtaggggc

SEQ ID NO: 56859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtcagtattaacaaggcgaatttctgaat

SEQ ID NO: 56860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtcagtattgagcttccgggatgctcaaa

SEQ ID NO: 56861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtcatgtctcggtaaggtcaaatccgtag

SEQ ID NO: 56862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtccagtctccgagttccgcggtctatac

SEQ ID NO: 56863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtccgaagatgctcactatggccatgcac

SEQ ID NO: 56864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtcgatagtgtcggtgggtggctaagggt

SEQ ID NO: 56865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtcggagttcggtcttgattggtttactt

SEQ ID NO: 56866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtcggtgaggtatctctccttggttagtg

SEQ ID NO: 56867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtcgtggggagtcctgctccaaactcggc

SEQ ID NO: 56868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtctcaaaggcatggttgggcggcggggg

SEQ ID NO: 56869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtctcatagcacaatgctaccggtcccgt

SEQ ID NO: 56870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtctgaagtgttatgctgcaccccggttc

SEQ ID NO: 56871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtctgctattggactgatagccgtcgggt

SEQ ID NO: 56872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtctggccatcggaccctggtgggattgg

SEQ ID NO: 56873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtctgtgcagttcagcgaggtagtgagaa

SEQ ID NO: 56874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtcttataaggccaagaattaatgcgcct

SEQ ID NO: 56875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtcttatcggctaatatacgtgtttaggt

SEQ ID NO: 56876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgaagcggcatcgggggcgtcgtctatc

SEQ ID NO: 56877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgacactgaaatataaccccgagccggt

SEQ ID NO: 56878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgacgtttgccttgtgtcagtggtgaca

SEQ ID NO: 56879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgaggcgtcgtttcgaggtattcggtcc

SEQ ID NO: 56880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgattacttgtctaactgatggttaaaa

SEQ ID NO: 56881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgatttgggaccattgtgcggccatttt

SEQ ID NO: 56882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgcaatgcatgtgagatcctctggggct

SEQ ID NO: 56883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgcacatgcgtacaatcgctcatggtct

SEQ ID NO: 56884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgcacgtgccttggttgtcctggtaagg

SEQ ID NO: 56885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgcaggattttcatggactgttcgcaca

SEQ ID NO: 56886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgccgacactgcatgattcggtggggag

SEQ ID NO: 56887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgccgcagaaatgctcttggtgagattg

SEQ ID NO: 56888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgcgcacatgtgttactaacttgacctg

SEQ ID NO: 56889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgcggaaacgacaggtaggatacactcc

SEQ ID NO: 56890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgctatcgtgctcccatcaggcggataa

SEQ ID NO: 56891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtggaatgcaccgtttcagtgtggccagc

SEQ ID NO: 56892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtggaggtctgcttgcttgactgtgtctt

SEQ ID NO: 56893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtggaggttatcccactcatgactggtgg

SEQ ID NO: 56894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtggatggcgctagtacgtgcacactgtc

SEQ ID NO: 56895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtggccagtcccccttgctgcacagtggg

SEQ ID NO: 56896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtggcgctagcttctgtcggaccttggtg

SEQ ID NO: 56897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtggcgctgctcactgccttacggtgagt

SEQ ID NO: 56898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtggctcgtcgggactagtcaggggaacg

SEQ ID NO: 56899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtggctgcgcggatgttttgatttgcact

SEQ ID NO: 56900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgggttggcgtagctactccagagttac

SEQ ID NO: 56901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtggtatcttggggtccctggtaggatga

SEQ ID NO: 56902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtggttggtgatgggggtccgtaagtggc

SEQ ID NO: 56903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgtacttagtccgtgatctgtcggagcc

SEQ ID NO: 56904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgtagaacatctcacgggttatgtggtg

SEQ ID NO: 56905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgtatgtattcggatattctccggcgtc

SEQ ID NO: 56906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgtcaactcacccggcatcatcgacggc

SEQ ID NO: 56907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgtcataccggggtggttcactagacat

SEQ ID NO: 56908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgtggagtggcggtgtcattggtataca

SEQ ID NO: 56909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgtgtactgttatcgtcggcctaagcgg

SEQ ID NO: 56910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtgtttaacgcgtagtaagatttgtcttc

SEQ ID NO: 56911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttaaactggtctcgtctcaactttcctc

SEQ ID NO: 56912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttacctatattggttccggattgtgggc

SEQ ID NO: 56913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttaggtgggcaggtcgaggcatgtacga

SEQ ID NO: 56914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttatcttcggccgttaatgcgggctggt

SEQ ID NO: 56915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttatggtacccgagatattcaggcactt

SEQ ID NO: 56916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttcaactcgtgctaagcaatcaatcata

SEQ ID NO: 56917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttcactcttcagagggcaaggagttgcc

SEQ ID NO: 56918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttcatccctctcctatccgcgtccggca

SEQ ID NO: 56919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttccaaccaggtagctctgggttcggtt

SEQ ID NO: 56920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttccgatgcacaggagtttgacccctac

SEQ ID NO: 56921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttcctgttgaatgctgactagcaagctc

SEQ ID NO: 56922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttcgatggtaggccccaatacggccagc

SEQ ID NO: 56923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttcgtagctcgctcacgaggacaggaga

SEQ ID NO: 56924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttgaccagaattggtacggtagccgggt

SEQ ID NO: 56925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttgcacgaagggattcattctgtaggat

SEQ ID NO: 56926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttgcaggattttcgctgattgatttagt

SEQ ID NO: 56927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttggagcgtagcgtaggcgggagggttg

SEQ ID NO: 56928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttggttgtgttttccctctcatatcctg

SEQ ID NO: 56929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttgtacacggaaagcacactaagcggac

SEQ ID NO: 56930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttgtgggattcagttcggacactactgc

SEQ ID NO: 56931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtttagaggcccgcaagctcccacttcgt

SEQ ID NO: 56932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtttcccattcggtgggagggtggtgagt

SEQ ID NO: 56933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtttgcacgcgtttatgccctttacgatg

SEQ ID NO: 56934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtttgcgaactggcacgccttaattcccg

SEQ ID NO: 56935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttttactaaccaaaatgcaggttaggtc

SEQ ID NO: 56936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggttttgcgcagatgcatccgaagagcgcc

SEQ ID NO: 56937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtggtttttcatccagggcttctacctgggga

SEQ ID NO: 56938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaaatgttcggccagacaggaggaggtag

SEQ ID NO: 56939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaacgatggtagtacagtgccgttctggg

SEQ ID NO: 56940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaacgcgttgtgtacagaccactattggg

SEQ ID NO: 56941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaacttaatccagcgggatctgtctccat

SEQ ID NO: 56942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaacttgtgtatatcttagtcggatgcgg

SEQ ID NO: 56943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaagaggaggccctgtttatggtaaatga

SEQ ID NO: 56944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaagcacagcggattggtgggctgcatac

SEQ ID NO: 56945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaagcggtctcgaggtgaagagtctgccg

SEQ ID NO: 56946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaagggcctccggttgcttcgtggcgttt

SEQ ID NO: 56947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaagggtggcggttccctaggtggggccg

SEQ ID NO: 56948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaaggtttaccaggaactacacaaccgta

SEQ ID NO: 56949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaagtgctcagtatgtagggtccgaaaca

SEQ ID NO: 56950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaagtggctagtgtcaccctgtcattatt

SEQ ID NO: 56951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacaaacgacggcttgactgctacggtgc

SEQ ID NO: 56952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacacgatgaagtcactatgtgacacagg

SEQ ID NO: 56953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacacgggcgatgcggcctgcttggtgta

SEQ ID NO: 56954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacataggctcatagcgcaagtcggcacg

SEQ ID NO: 56955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacatcgtgtagtagggtccgttaaatgc

SEQ ID NO: 56956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacatttgtaggtattgtgcgaaacacgg

SEQ ID NO: 56957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacccattgatcggtcatggcgtaatgga

SEQ ID NO: 56958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacccgaacggcgcgcccagactcaccgg

SEQ ID NO: 56959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaccctgtgtcctgtcccatgcgtaaccc

SEQ ID NO: 56960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaccgacgggccataaagcaggccatatc

SEQ ID NO: 56961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaccgcgggtcaaaatgtgcgcaatgcgt

SEQ ID NO: 56962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacgacggagtctggctcttcggcgcagg

SEQ ID NO: 56963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacgaggtctgccaggtccgtcctaacta

SEQ ID NO: 56964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacgccggtcgggtttttgaagtggggat

SEQ ID NO: 56965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacgctccatgtctggtgatgttgtgtgc

SEQ ID NO: 56966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacggatcgggtacaagtcaaagagacac

SEQ ID NO: 56967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtacgggttctggaacagagtccgcgggtg

SEQ ID NO: 56968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtactacctcgtatcatcgttaggaccgcg

SEQ ID NO: 56969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtactatcgcgagtggcgtgccttcgccgt

SEQ ID NO: 56970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagaaggtaggagggggttccgtgcatac

SEQ ID NO: 56971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagaccttatctcttttgacgccgattga

SEQ ID NO: 56972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagagtcccgttctgcgcttccaggcttc

SEQ ID NO: 56973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagagttgagaatcacccttcggtggagg

SEQ ID NO: 56974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagatccttaagcatttacccaggtgagt

SEQ ID NO: 56975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagcattgggcatcgggggtctgtgaggg

SEQ ID NO: 56976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagccaccttgacgtggggtgtcgatgcg

SEQ ID NO: 56977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagccattgtctgagcaggcttcttgagc

SEQ ID NO: 56978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagccccaaggcatctcaagcgccgaatc

SEQ ID NO: 56979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagcgatgccgcttgcactgcactagact

SEQ ID NO: 56980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagctcggccctgtaaagcggtttggtct

SEQ ID NO: 56981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagctttgtgttatcagcgtacattactg

SEQ ID NO: 56982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagggatcgacagtgctccatggccatag

SEQ ID NO: 56983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtaggggtagattcactttcgtgggtgagc

SEQ ID NO: 56984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagggtgggcttcgtctgctagtcttttc

SEQ ID NO: 56985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagtgagcaatgtatcgccttcctggatt

SEQ ID NO: 56986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtagttagcatttccgtcgctcttgagatg

SEQ ID NO: 56987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtataaatctctgtgacttattcgtatagc

SEQ ID NO: 56988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatcagtatttagtcctttgccacgtctc

SEQ ID NO: 56989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatcgctgacgtcccataacgcactcatt

SEQ ID NO: 56990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatctaagagcacgttcggaatgacttag

SEQ ID NO: 56991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatctcgaaagcgtggcttgaggctaggt

SEQ ID NO: 56992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatctggcgagcctcgctgttaatccggc

SEQ ID NO: 56993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatgccacttgtgcggatcgtctgatttg

SEQ ID NO: 56994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatgccgcgattggtcagttgctggacgt

SEQ ID NO: 56995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatgcgtaggtaaacgtttgggcttcgtg

SEQ ID NO: 56996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatggagacgatctaggggcgccaatcgt

SEQ ID NO: 56997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatggccggagctttctgacaacatagtg

SEQ ID NO: 56998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatgggctgcacacaatgtctgggttaag

SEQ ID NO: 56999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtatggtacaggcatccacacgggtatccg

SEQ ID NO: 57000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtattgcgcaaggaccggacccagctgtgc

SEQ ID NO: 57001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcaaatcgagtttagtggcctcgtgcacg

SEQ ID NO: 57002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcaagttgtctcgggatggcggctggcgg

SEQ ID NO: 57003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcaatgtggctccgaggggacgttagccc

SEQ ID NO: 57004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcacctaacgaatagcacatcggatgagc

SEQ ID NO: 57005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcacggaggaatcttccctgctggtatcg

SEQ ID NO: 57006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcacgtcttaccgtcgcgtgcccgaccgg

SEQ ID NO: 57007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcactgtctgaatccaagtcttccgaaac

SEQ ID NO: 57008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcacttagttccttagttactatgggaac

SEQ ID NO: 57009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcagaagcgtggcggggatctgctcattt

SEQ ID NO: 57010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcagcgaatcgctttagctgtttgctcat

SEQ ID NO: 57011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcagcgtccaacctacctatttggaactg

SEQ ID NO: 57012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcaggattaggcggtctcatcgctataac

SEQ ID NO: 57013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcaggcggcgcagatcggtttggcccgcg

SEQ ID NO: 57014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcagttcctcccgaagctaggccagcggt

SEQ ID NO: 57015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcatatgtagtacatgtaagtttataggg

SEQ ID NO: 57016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcattgagtgcctgtccacaggcttgtta

SEQ ID NO: 57017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccaacgtactcaggccggaggcggcgac

SEQ ID NO: 57018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccacggagaagttggtattaaaactgca

SEQ ID NO: 57019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccactgacctgatgtagaggacgattga

SEQ ID NO: 57020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccagatgtattgatgcggaactcaacgc

SEQ ID NO: 57021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcccacgccgaagtggcacaatggcaccg

SEQ ID NO: 57022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcccagtcgcataggatgtctggggcttc

SEQ ID NO: 57023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcccatcctgccgctcgtgggatatgatg

SEQ ID NO: 57024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcccctttgcgatagagtaacggtgtttt

SEQ ID NO: 57025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcccgcgcaccgtgcttcgagtctcgaag

SEQ ID NO: 57026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcccgcgtgtttggaggatctgcggtgcg

SEQ ID NO: 57027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccctttgattgtgccatcgatacccggg

SEQ ID NO: 57028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccgagaacggacgaggtcctgcttagtt

SEQ ID NO: 57029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccgcggctagggctcaggtctgttatag

SEQ ID NO: 57030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccgcttgggattaggtctccttccgacc

SEQ ID NO: 57031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccggacgtgttagtaccggtttgagccc

SEQ ID NO: 57032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccggtggttcgttcttgtcggagtctat

SEQ ID NO: 57033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccgttcagtgtgggatagtacgacaacc

SEQ ID NO: 57034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtccgttggattcgttagctttcgtcgcgt

SEQ ID NO: 57035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcctgctctttacgcaacacaggcgcgag

SEQ ID NO: 57036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcctgtggtgctgggaggattcgtacgag

SEQ ID NO: 57037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcctttccctcctttttccatgcggtttt

SEQ ID NO: 57038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcgcaccattctcgtgtgttccctcctaa

SEQ ID NO: 57039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcgcatttcgttcactgccgagttgtata

SEQ ID NO: 57040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcggaagcacaattgactgcatagactgc

SEQ ID NO: 57041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcggaagtagcccagaagctctgttgtac

SEQ ID NO: 57042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcggattatgtcatcgggccgatttagtc

SEQ ID NO: 57043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcggccgtgttgggaggccatcgcgatcg

SEQ ID NO: 57044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcggctcttcagcatggctttgggggctg

SEQ ID NO: 57045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcgggagctccagtgcagcgacgatacga

SEQ ID NO: 57046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcgtaccggtggcaattgtgtcgtacgga

SEQ ID NO: 57047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcgtggaagtagactgtatacaggccggc

SEQ ID NO: 57048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcgtggtacacgggatatgcgaaggctta

SEQ ID NO: 57049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcgttccatgggcttcggagggtccaagt

SEQ ID NO: 57050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcgttcgttcttagtgcaccagccgtcct

SEQ ID NO: 57051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcgtttgcgttgtcccgacaccgcaggcg

SEQ ID NO: 57052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctaaacgtgtagcgtttgtttgatgttg

SEQ ID NO: 57053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctacttcggcgcacatgattcgcagtca

SEQ ID NO: 57054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctagagcgtaggatccagctgcgtatgg

SEQ ID NO: 57055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctatggggtctgatcgagcttatgatcg

SEQ ID NO: 57056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctcaagccataggttgggaccggttaca

SEQ ID NO: 57057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctcgcccatcggtaatctcgtgttttcg

SEQ ID NO: 57058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctcgtcacataggcgtgtgttagtgcga

SEQ ID NO: 57059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctctcaagcgttttcttttcgtctggcc

SEQ ID NO: 57060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctgcaattcttgggcgatattgttaggt

SEQ ID NO: 57061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctggcatgtgtggagggctctgcaaaca

SEQ ID NO: 57062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctgtttttactggagcgttctgattcct

SEQ ID NO: 57063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtcttcccgctctgggcctaactgtcgggg

SEQ ID NO: 57064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctttcaggttgggagaatagtgtggcgg

SEQ ID NO: 57065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtctttccggccttttgtatcgggcgatgt

SEQ ID NO: 57066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgaaatggaggcggtgtcttgtgagtggc

SEQ ID NO: 57067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgaatgttaactgccaacgcatctctaga

SEQ ID NO: 57068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgacgctatatgtcttacctccttcacgc

SEQ ID NO: 57069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgacggctgagatagtccctacgtccatc

SEQ ID NO: 57070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgacgtgcctggaggtgttttgctagaca

SEQ ID NO: 57071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgactcctggcgtaccggtaacctgcctc

SEQ ID NO: 57072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgacttcgtaaacaacaacgtgttgcctt

SEQ ID NO: 57073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgagatcgaccgtcagcgaggcagactta

SEQ ID NO: 57074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgagggtgagtgcgaagaccccaggacgg

SEQ ID NO: 57075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgagtccggacagtctaattatagggatt

SEQ ID NO: 57076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgatagttgtataggggtagtagctcaca

SEQ ID NO: 57077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgatataccccatcctatgcacgacacgg

SEQ ID NO: 57078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgatcctcgatgcctgcgtggcgacgaag

SEQ ID NO: 57079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgatgatggctgctttcgtgaccaatcgc

SEQ ID NO: 57080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgattcattacgataggctcgcatgctct

SEQ ID NO: 57081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcacgcgtctgacgccactaaatcacgg

SEQ ID NO: 57082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcagcagttacgcgaatggaaggttgct

SEQ ID NO: 57083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcagcatatccgatgtgacctgaacagt

SEQ ID NO: 57084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcatcgccactcttccggctcaacgccc

SEQ ID NO: 57085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcattgatcggattagttgcggagggcg

SEQ ID NO: 57086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgccaatgtgggtagctgccctttgcctg

SEQ ID NO: 57087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgccatttggactattctttgggagtatt

SEQ ID NO: 57088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcccacttggcagccgcatgagatcgca

SEQ ID NO: 57089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcccaggtacggtgcgagagggcctggg

SEQ ID NO: 57090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcctctctggctggttaatcaggtaatg

SEQ ID NO: 57091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcctgcgagcaaaaccgcctcctatggc

SEQ ID NO: 57092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcgagacccacgccattatggcattatc

SEQ ID NO: 57093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcgcccgggtgggttttgttttacgagc

SEQ ID NO: 57094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcgcggcgtgttgtagccttttgctcgt

SEQ ID NO: 57095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcggcatacgacagtgatggcgcagtgt

SEQ ID NO: 57096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcgtcgagtgttgcggttttgcttgaga

SEQ ID NO: 57097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcgtctcgttaggacggtcggacctgga

SEQ ID NO: 57098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcgtgccgatgatgcgctttgagcgacg

SEQ ID NO: 57099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcgttagcgttgtctcggggggagcact

SEQ ID NO: 57100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgctgcagtctatgggaggagaagaccat

SEQ ID NO: 57101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgctgccagtaggtcactggggcccgatt

SEQ ID NO: 57102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgctgccagtgcgccgcttgtttagtgtg

SEQ ID NO: 57103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgcttaagatcatcacgcaatggctcagg

SEQ ID NO: 57104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgctttttgaaatgaatcactgggccatc

SEQ ID NO: 57105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggaacatcacaaggggtgttcctgatct

SEQ ID NO: 57106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggaagcagtaaatcatttcgcctcacta

SEQ ID NO: 57107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggaatgaccacgagcgttttggtgccgg

SEQ ID NO: 57108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggacaagtggggtgggccggtattagcg

SEQ ID NO: 57109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggaccactctttgtttgtagtgcacgtt

SEQ ID NO: 57110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggacggatccgagacattgtattgtggg

SEQ ID NO: 57111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggacggtacgtgaacatgcgggcccata

SEQ ID NO: 57112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggcagggcccgcggctactgtttcaggg

SEQ ID NO: 57113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggcagtcgttatttgaggattgactggc

SEQ ID NO: 57114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggccaacgtccatgtgcactcggcaagc

SEQ ID NO: 57115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggcgcgtcagggatgcatggggttcgcc

SEQ ID NO: 57116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggcggtcgactgcggcaacgagttaggg

SEQ ID NO: 57117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggcgtggcgtccaccaacgtcaacctcg

SEQ ID NO: 57118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggctgagcttagtgtggtcgtgtaaact

SEQ ID NO: 57119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggcttgaagaaacaccttggattaggcc

SEQ ID NO: 57120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgggacgcgacgtatgtttcatggaattt

SEQ ID NO: 57121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgggcgaagaggaggggtgcatattgcgt

SEQ ID NO: 57122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgggcgcaagtccgaaagttgcttggcaa

SEQ ID NO: 57123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggggcggctagcgtagacatttttaggt

SEQ ID NO: 57124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgggggatcagtggcgtgacctcaatttg

SEQ ID NO: 57125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgggggcgttaacctctagggcgtcggga

SEQ ID NO: 57126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggggttcggcaacaagccgtttggcgtt

SEQ ID NO: 57127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgggttcgcatttatgcgtcaaggtgatg

SEQ ID NO: 57128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggtcaagtttacgagttagcgtccagat

SEQ ID NO: 57129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggtcgccgtatagtatacttcgcgggct

SEQ ID NO: 57130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggtgtgtacttatcgggggggttgctta

SEQ ID NO: 57131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtggttacgaagtatcgagagtttctggtc

SEQ ID NO: 57132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtaacaagcggggcgacgtccgatgatt

SEQ ID NO: 57133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtagctcggttgcgcggttcttccaaag

SEQ ID NO: 57134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtagtgaaccgataatcgcaaactctgc

SEQ ID NO: 57135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtcatagcccatcgcgagcacgtgtccc

SEQ ID NO: 57136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtccacatttgtgtaaatctgaacaagg

SEQ ID NO: 57137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtccatatccatgtttgagagttttttg

SEQ ID NO: 57138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtccgtagcgacaaacgcactatgcaca

SEQ ID NO: 57139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtgcatggtaaaggacttgtagtcgtga

SEQ ID NO: 57140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtgctgtcaaccaaccggaccgccccac

SEQ ID NO: 57141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtggaatgagtccagaggatgcatcgcc

SEQ ID NO: 57142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtggcacggcagcacattttggtcatca

SEQ ID NO: 57143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgtgtataattcccctcctctccgtacca

SEQ ID NO: 57144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgttaacttgcggccatgttaagctggca

SEQ ID NO: 57145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgttacggggctttagttgctgttgtcac

SEQ ID NO: 57146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgttcagaaagtcgttgcggaatacattt

SEQ ID NO: 57147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgttcgagtgcgactgggcacttgtccgg

SEQ ID NO: 57148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgttctccgctctaagtcacctgtccacg

SEQ ID NO: 57149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgttgatctgcggagcgggagaccgacgg

SEQ ID NO: 57150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtgttggcgcattattgtggttatcatact

SEQ ID NO: 57151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttaaaggctctgggcatacgtgcgccgag

SEQ ID NO: 57152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttaaccggttccatttttgtatgttttat

SEQ ID NO: 57153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttaactcctactcgtatttcttgcctatc

SEQ ID NO: 57154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttaatgtctattggagggagggctgggtg

SEQ ID NO: 57155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttaatttatgtgcgactatgtcattagaa

SEQ ID NO: 57156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttacatagaaggatacctggattgatccg

SEQ ID NO: 57157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttacgcttagctattctgcgtgtgtctcg

SEQ ID NO: 57158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttagcatgatgcggatcttgttgactccc

SEQ ID NO: 57159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttagctctttattccttacagcagctgat

SEQ ID NO: 57160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttagtcattcacgctaactaggttcaccg

SEQ ID NO: 57161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttagtctgagtcccgactcttggttcatt

SEQ ID NO: 57162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttatcacggttccggtttctttgcgtatc

SEQ ID NO: 57163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttattacggtttgtgtgggatcccgcgca

SEQ ID NO: 57164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcaatggaatgcgtcgttggggtaccgg

SEQ ID NO: 57165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcaattgtggtcggtatcgggaactcgg

SEQ ID NO: 57166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcacagttcccattaagggcgttatgac

SEQ ID NO: 57167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcacatttccagttctgcttgtgacttg

SEQ ID NO: 57168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcacgggcggcattggcttcgtatgagc

SEQ ID NO: 57169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcaggcgttcaggctgcaggcttttggc

SEQ ID NO: 57170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcatacaaccgacaattgatagggtatc

SEQ ID NO: 57171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcatcaagttgcactgccactctctgtt

SEQ ID NO: 57172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcatggcgtaatgtactttgcccttgcc

SEQ ID NO: 57173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcccaggtcatggtgagacccgcgccac

SEQ ID NO: 57174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcctctgtgatcatgcccgatgtggccc

SEQ ID NO: 57175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcgaattttaccattcactgtttgttaa

SEQ ID NO: 57176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcgagggcgactgaggactttggatggt

SEQ ID NO: 57177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcgcaccaaaccttttcgtgcgaatgaa

SEQ ID NO: 57178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcggaagaggcgtgcgaaagggtaccct

SEQ ID NO: 57179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcgggggcttcgttcattttagcacttg

SEQ ID NO: 57180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcgtctccaagctccagccttgttcaag

SEQ ID NO: 57181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcgtgctgagtgcaggctttcatcaggg

SEQ ID NO: 57182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttctaagctgatgaccgtagcgcgccgtg

SEQ ID NO: 57183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttctgcctgatgactaacgtggtgatcgc

SEQ ID NO: 57184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttctggaggcgtagatatgtaactccaca

SEQ ID NO: 57185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttctggccataaaagtttgatccctgata

SEQ ID NO: 57186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttcttcactttccttatggaattctaatg

SEQ ID NO: 57187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgaattaaggacatagttctattttagg

SEQ ID NO: 57188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgaccatatgtcacgtgcgatgttcatg

SEQ ID NO: 57189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgacggagacctattggccagccggggg

SEQ ID NO: 57190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgactttgcatctacgggtattggctcg

SEQ ID NO: 57191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgatggcgtaatctcgttttctgaggtc

SEQ ID NO: 57192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgattgattcggatagtgtgctgcatac

SEQ ID NO: 57193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgcaactacgtatagtcggtgggcggac

SEQ ID NO: 57194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgccagtgaaaaccaacatcgaacgttc

SEQ ID NO: 57195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgccgaagtaatcgcggctttcgtggcg

SEQ ID NO: 57196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgccgtccgatatagtcgcgttctaata

SEQ ID NO: 57197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgcggatactgatcgttacgtcctcggg

SEQ ID NO: 57198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgctggcgtgtgtgtagatgctcaggcg

SEQ ID NO: 57199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgctggtgtagggtggaagggtttagcc

SEQ ID NO: 57200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttggagctagcccgtgttcgatagcggtt

SEQ ID NO: 57201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttggaggtcgatacggcacgtactgcctg

SEQ ID NO: 57202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttggccatcaatcgcgattaatgctggat

SEQ ID NO: 57203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttggggcgtgggaaccttagtgtgctctg

SEQ ID NO: 57204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttggtccgatgcattttgcgtgttctgat

SEQ ID NO: 57205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttggtcggatccggaaggcttgcccgccg

SEQ ID NO: 57206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttggtgggtataactggaacttcgtcgcg

SEQ ID NO: 57207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttggtgtagggcaggccacaggcggggat

SEQ ID NO: 57208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgtacgcatctggctgtcttgttcggtt

SEQ ID NO: 57209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttgtgatgtcacttttaggtcagttgggg

SEQ ID NO: 57210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttaccttagataacttgagtgacgccga

SEQ ID NO: 57211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttacgtgaagggcttggaggcgattgcg

SEQ ID NO: 57212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttaggcgatcgaatggtccgtgctggta

SEQ ID NO: 57213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttagtggatctggtcacggcatcttccg

SEQ ID NO: 57214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttagttcaccaactgtctacaataggtt

SEQ ID NO: 57215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttcagtggccacaatagatatcggaagt

SEQ ID NO: 57216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttcatttccatccgacagaagctcatcc

SEQ ID NO: 57217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttccgcttgttttggagagtggagtgtt

SEQ ID NO: 57218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttcctattatgcagtatggttaaattcg

SEQ ID NO: 57219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttccttgtcagcacgttgtcgacacaat

SEQ ID NO: 57220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttctgtcgtactaagcctcggggtaatc

SEQ ID NO: 57221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttgcatgccgttcttatcgcgtcctgtt

SEQ ID NO: 57222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttgccgtactccatctttggttagcgtg

SEQ ID NO: 57223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgtttgtaatacatgatgtcttatcccacgc

SEQ ID NO: 57224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttttaactgtatgccgtccgatcgacttg

SEQ ID NO: 57225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttttaagtagctgaccgtacgacgcgaga

SEQ ID NO: 57226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtgttttgtaagttcctttctgtgtctgtgcc

SEQ ID NO: 57227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaaagtaagccgagtcaacgtacgcactt

SEQ ID NO: 57228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaaattggtcctgggacagcgagctatct

SEQ ID NO: 57229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaacacgcggcaattcttatgagtgcgtc

SEQ ID NO: 57230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaacagtcgcactaatgtgaatcgggtat

SEQ ID NO: 57231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaaccccccttgtctactgtttaggccct

SEQ ID NO: 57232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaactccttcgcgcttctaggcatatcgc

SEQ ID NO: 57233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaaggctcaccggcaactccctgccctct

SEQ ID NO: 57234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaagggctcagggattgggatgggtctgg

SEQ ID NO: 57235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaagggtcaatagacagcagttcagcggc

SEQ ID NO: 57236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaagtcttaaaagatctgttgtagtcttc

SEQ ID NO: 57237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaataggcgagaattaagcttagcaatct

SEQ ID NO: 57238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaattgttttacggggttcagtccgggct

SEQ ID NO: 57239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaacacgcgctcctatgaaaagccgcagac

SEQ ID NO: 57240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaacacttcacaaggtgccaccagatcttg

SEQ ID NO: 57241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaacagggaccctttgcgacttttggcttc

SEQ ID NO: 57242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaacattgtactcttataccgtgcgcctcc

SEQ ID NO: 57243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaccgagtagtctagcaggagcggctctt

SEQ ID NO: 57244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaccgtcccagtgcatgtgatgagggaag

SEQ ID NO: 57245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaacgagattgtacaggcccagtacagttg

SEQ ID NO: 57246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaacgcccccagtaattagtggtttgtgcg

SEQ ID NO: 57247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaacgctgacccatctctgtaagacgctgc

SEQ ID NO: 57248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaacggtcgtgggcatagtgggaggccgcc

SEQ ID NO: 57249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaacgtgacttcaaatcgggcactttcatt

SEQ ID NO: 57250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaactacacagaacagccgaaggagtaata

SEQ ID NO: 57251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaactacatgtcgacattctaccataaaac

SEQ ID NO: 57252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaactagcctatgccgcaacagatgaatcg

SEQ ID NO: 57253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaactagctctcgtttgttagtgtccgcgg

SEQ ID NO: 57254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaactgataatagtcaacctccaggcgccg

SEQ ID NO: 57255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagagatagcctgatcaccctgagcctct

SEQ ID NO: 57256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagattgagaattgacgaatagtgcgtcg

SEQ ID NO: 57257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagcaggctgacaatgggtgggcggttta

SEQ ID NO: 57258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagcccctcggacatcagggagtagtgtg

SEQ ID NO: 57259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagcgaatagcgatctttaccttactgag

SEQ ID NO: 57260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagcttcactcctcggttctacaaatcct

SEQ ID NO: 57261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagcttgacaggccctccggaagcggtat

SEQ ID NO: 57262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaggatcagttatgtaccaaagttcgggg

SEQ ID NO: 57263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagggcggacactgaccgattaactagca

SEQ ID NO: 57264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaggggattcgtggtgctcggttaggcgg

SEQ ID NO: 57265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaggggggaacgatccgacttctggtccc

SEQ ID NO: 57266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaaggtgctcgatggacgtccgctgttttg

SEQ ID NO: 57267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagtagtcagggtacatcaaagacccaag

SEQ ID NO: 57268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagtccgtgtattgtctacgattctgatc

SEQ ID NO: 57269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagtcgttctgcgattagctatcgtccgg

SEQ ID NO: 57270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaagttgattgtttgaggcaacgcggctag

SEQ ID NO: 57271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatatcgtacgagaggctggtcgtctggg

SEQ ID NO: 57272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatcaaccgggagttaatatagattaatt

SEQ ID NO: 57273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatcctctggactatctacccgtgtctta

SEQ ID NO: 57274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatcggtgcacagactacgtgaatcgggt

SEQ ID NO: 57275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatctgattaacgggctgatacttggtcc

SEQ ID NO: 57276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatcttttttgtttggttttgctcgcggc

SEQ ID NO: 57277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatgacaagacgcgttttgtctggtcgcg

SEQ ID NO: 57278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatgcatttgtggttcccgaggccaatcc

SEQ ID NO: 57279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatggcgtcgttccttgcgtgtggtgcgc

SEQ ID NO: 57280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatgtgaggaccggtaatcgccctatagc

SEQ ID NO: 57281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatgtgtttatcggggccatcgaccctcg

SEQ ID NO: 57282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatgtgtttgatgttttagcaggcgacaa

SEQ ID NO: 57283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaattatccacgacggacggtattctttat

SEQ ID NO: 57284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaatttgggcgaggcgggtagtatggtctt

SEQ ID NO: 57285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaattttacctactgcgattttgatttttc

SEQ ID NO: 57286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacaaaagggttgtaggcgtcgatttgact

SEQ ID NO: 57287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacaaccgggtcaaggttttaacgacgtgg

SEQ ID NO: 57288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacaacgcgtcataagttgtaaatccatga

SEQ ID NO: 57289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacaagacagggggagggcacctggctagg

SEQ ID NO: 57290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacaaggcaatgagccgttaggtgaggtgt

SEQ ID NO: 57291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacaattgggtcactgtcttttgtgttttt

SEQ ID NO: 57292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacacatcatatcgttaatccggcctgtag

SEQ ID NO: 57293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacacccgggagaaaaaggctgccttgcca

SEQ ID NO: 57294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacaccgtttgatatctggtgaccccggtc

SEQ ID NO: 57295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacaccttactttttgatgctttgagggga

SEQ ID NO: 57296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacacgatccccgtagcacgttgaatcaag

SEQ ID NO: 57297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacacggatcgcacacaggagtcgtgccgg

SEQ ID NO: 57298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacacggtgatcactagagttgtagggtct

SEQ ID NO: 57299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacactatcgggcggaggaggttgctgtgc

SEQ ID NO: 57300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacactgcggatttgtgcacatgccttggt

SEQ ID NO: 57301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacagattcgactgataagcaacggtcagc

SEQ ID NO: 57302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacagccgtgcgagggtcattaggaggctg

SEQ ID NO: 57303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacaggaataagcgggtagacgttgccggt

SEQ ID NO: 57304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacaggatgcgatattttgacccacaagtt

SEQ ID NO: 57305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacaggttcggtaccaacaatctatcactg

SEQ ID NO: 57306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacagtgagtaaagtgcaccacgtccaatg

SEQ ID NO: 57307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacatcgagcatttacttagcgcaacgtgg

SEQ ID NO: 57308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacatctgttgctatattttgcatgcatag

SEQ ID NO: 57309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacatggcgtctcgtatcgaaacaaagtga

SEQ ID NO: 57310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaccagaggcaaaggtgctgcgtggcctgg

SEQ ID NO: 57311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaccagtcgtctgccgggcgagactatgct

SEQ ID NO: 57312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaccatgataaacattgttactgggttggt

SEQ ID NO: 57313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacccggaatgttcacgccggactcagggg

SEQ ID NO: 57314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaccgatcaaatgatcaggtggtggcttct

SEQ ID NO: 57315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaccgggctaacaacagcgctttcctacta

SEQ ID NO: 57316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaccgtacacactgagaacatactatgcac

SEQ ID NO: 57317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaccttattatggttttcgttagagtgcga

SEQ ID NO: 57318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacctttaataattaggctctgtcgcgttg

SEQ ID NO: 57319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacgcccgggccgtcacacgagcgtccatg

SEQ ID NO: 57320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacgccgcggaggtcatctatactgtcggg

SEQ ID NO: 57321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacgcctgagatgagtgacgcctttcatgt

SEQ ID NO: 57322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacgcgagtcactccccacctgatgggcgg

SEQ ID NO: 57323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacgcgcgaataaatcgtgtgaaagtccgg

SEQ ID NO: 57324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacgcgggcgaggcgaagcgagtttgtgtg

SEQ ID NO: 57325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacgctggactcaaaatctatcggttatgg

SEQ ID NO: 57326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacggacgtaccaagtcgaggcaggttagg

SEQ ID NO: 57327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacggatactggctcaggtgttacaaatct

SEQ ID NO: 57328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacggattgggtcaaccgaaacagaggatg

SEQ ID NO: 57329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacggcgcaggtgagtccgggtactgcaac

SEQ ID NO: 57330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacgggaactctttgatctggtctgtgcca

SEQ ID NO: 57331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacgggccagcctacatctcaataatgagc

SEQ ID NO: 57332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacgggttatgagctcagtgtggactttat

SEQ ID NO: 57333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacgtagcctccatgtgcctgcgaaggtac

SEQ ID NO: 57334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactaacatagttggcggtatagtgaactc

SEQ ID NO: 57335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactagtggccctcatttccggctactggc

SEQ ID NO: 57336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactataatgccagggttgccttaggactc

SEQ ID NO: 57337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactatcaatctttcgctaggatgcatagg

SEQ ID NO: 57338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactatggaaccggcacttcacgcctggta

SEQ ID NO: 57339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactcatctgttcgtgtcattgaacgaagt

SEQ ID NO: 57340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactcattaatggatgggcggatcccttag

SEQ ID NO: 57341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactccggcttgccaaatcctgtcactgtg

SEQ ID NO: 57342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactcggatgtcagacctgtggattcgctt

SEQ ID NO: 57343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactggcgccctcacatttccaacattgac

SEQ ID NO: 57344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactgtgcagcagggggatacggacacgga

SEQ ID NO: 57345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacttatagcggcggtgcgtttgcattacc

SEQ ID NO: 57346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacttcggacattggggctttacagttgag

SEQ ID NO: 57347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacttggagcggcgttagcggacacaggtt

SEQ ID NO: 57348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttacttgtcactgagaaggcacatgcgaaag

SEQ ID NO: 57349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactttgacggtgccagttgtttgctggtt

SEQ ID NO: 57350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttactttgtcactgcggcgagaccacagtca

SEQ ID NO: 57351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagaaacaccttttttggatggttgtttgg

SEQ ID NO: 57352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagaaatcagtcctagagcttgcttttgcg

SEQ ID NO: 57353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagaacagggtgctcgctccttttgcgtcc

SEQ ID NO: 57354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagaatgggtattggttagccagccaaggg

SEQ ID NO: 57355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagacttgctgttgctcgcctggcggaatg

SEQ ID NO: 57356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagagcagagtttggctcgcaggcaagctc

SEQ ID NO: 57357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagaggtgtcaagccggtttcactggccga

SEQ ID NO: 57358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagagtgctagctttttcgtgtttaagtga

SEQ ID NO: 57359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagagtttacaaagtgacttcggcacatgt

SEQ ID NO: 57360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagataaagtgaataatgcgtgtggtatgg

SEQ ID NO: 57361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagatagatgaatcagcagagtcatgaaac

SEQ ID NO: 57362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagatagctacgaacactactcataagttg

SEQ ID NO: 57363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagatcgctggtgccagctggttgcactat

SEQ ID NO: 57364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagatcttatttcgcttttaattattaagg

SEQ ID NO: 57365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagattatggacacattcgacatgcacctg

SEQ ID NO: 57366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagcaacaccttgtctgagaaatatagacc

SEQ ID NO: 57367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagcatactctagcctggccccgtttctct

SEQ ID NO: 57368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagccacggttgttttgactgctagttcgc

SEQ ID NO: 57369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagccatggatcgttttgaacgtactgtca

SEQ ID NO: 57370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagccgatctccctgttactggcatcgggg

SEQ ID NO: 57371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagccgatgagaacgtcggcggtcattagc

SEQ ID NO: 57372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagccgccggttcatcgtctattggtttgt

SEQ ID NO: 57373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagccgtgatggaaggagcgtctgttgttg

SEQ ID NO: 57374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagcgactattaccgtgaaaagttcactgg

SEQ ID NO: 57375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagcgctgtgatgaaaagtacgttaggtcc

SEQ ID NO: 57376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagcggctgctttctttacacttgcagggc

SEQ ID NO: 57377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagcgtcagtgggagttatttagttgcatt

SEQ ID NO: 57378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagcgtgcttggtcatgagtatacacttgg

SEQ ID NO: 57379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagctgtttgttcggaggtacatttttttt

SEQ ID NO: 57380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagcttaaagtttacgtggtcgcttaggtt

SEQ ID NO: 57381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggacaacatggttggcacatgcgcacgt

SEQ ID NO: 57382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggacccgctatgtcagtaggaattagac

SEQ ID NO: 57383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggatctcggtaatgcatcgtgatgcgtt

SEQ ID NO: 57384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggcatgtgataactcacagtcatttttc

SEQ ID NO: 57385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggcctggcgacggcgaacgttcaatgcc

SEQ ID NO: 57386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggcggtccagcgcttttgtcggtactgg

SEQ ID NO: 57387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggctggacccatcaataggcgtgaggcg

SEQ ID NO: 57388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggctgggttgttggtctgcatgaggtgc

SEQ ID NO: 57389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagggccagcagcaatgcaaaatctgccgc

SEQ ID NO: 57390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagggccatttacggtcacttgcgggcacc

SEQ ID NO: 57391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagggcctctcaatcgctctccacattgtg

SEQ ID NO: 57392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagggcgaggaactcaccatagtgcccatt

SEQ ID NO: 57393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagggctgttatattttgtcggcggtcgtc

SEQ ID NO: 57394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggggagggcgttacctatgagtgtgtgg

SEQ ID NO: 57395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggggtacgggtggtgatgaaattcagtg

SEQ ID NO: 57396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggggtatcgacgcgtcgagggctagacg

SEQ ID NO: 57397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagggtcagcagagacacgcatgtaaccca

SEQ ID NO: 57398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagggtccgtatgtcttacgcggagcctgc

SEQ ID NO: 57399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggtagacattttgccgtgtatatctatc

SEQ ID NO: 57400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggtaggacgtcgaccatgaaacagtagc

SEQ ID NO: 57401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggtcgaccgatattcactacaccggcgc

SEQ ID NO: 57402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggtgccggttgtaagtacataggtatta

SEQ ID NO: 57403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggtgcggtcttttggaggtccgcgtgta

SEQ ID NO: 57404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggttatgggtctcgtgtataagcgtccc

SEQ ID NO: 57405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttaggtttaggattcgtatgggggatgataa

SEQ ID NO: 57406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagtatcgccgtcgaactgaattggtgtaa

SEQ ID NO: 57407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagtcagcacaagtcgattaagctacatgc

SEQ ID NO: 57408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagtccatcccacagtcgctcttcgatcgt

SEQ ID NO: 57409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagtcgatggggatgtagtcttgagtcccg

SEQ ID NO: 57410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagtcttgtttacttaatgatagttgttgg

SEQ ID NO: 57411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagttaaacgtgcaccgcgttcttagtgag

SEQ ID NO: 57412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagttagtaacatcacagaatagattggac

SEQ ID NO: 57413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagttcggaactgccattccccgccgtctc

SEQ ID NO: 57414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagttcttgccttcctacgcgctggaacga

SEQ ID NO: 57415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagttggccgctcaattgctacgttcgtgt

SEQ ID NO: 57416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagttgtacatccgtaggtggcatgtcagg

SEQ ID NO: 57417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagtttaaggcaccacgttacacctgcgtc

SEQ ID NO: 57418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttagtttgcgtgcccggttttcagagagtga

SEQ ID NO: 57419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttataacgatctcgatttggccacaccgccg

SEQ ID NO: 57420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttataactccggcgggcaaacaggcactgga

SEQ ID NO: 57421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttataagatgactgtggatttcattgggtcg

SEQ ID NO: 57422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttataatcgcgccgtagccacaccggccata

SEQ ID NO: 57423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatacttgttgtttctttcgtttcatgtgt

SEQ ID NO: 57424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatagaaaccgcccggtcggcttggctaga

SEQ ID NO: 57425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatagcaaaaagcatattatatatgatggt

SEQ ID NO: 57426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatatagctcgttatatcttggttgtagcg

SEQ ID NO: 57427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatatcaaggccattcgtatacttccctcg

SEQ ID NO: 57428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatatgccatcgaggtatcttccgcgttcg

SEQ ID NO: 57429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatattgaacgcgctcctgtttgcacccct

SEQ ID NO: 57430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatcaacgatgggtatgtggcttgtaattt

SEQ ID NO: 57431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatcaagtggttatctcccgaaccatgtgg

SEQ ID NO: 57432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatcaggcgggttgcttgccggggctttta

SEQ ID NO: 57433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatcataaggcaggtgtcaagagccgggtc

SEQ ID NO: 57434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatcatttgagtggatgtgtcaaggatcac

SEQ ID NO: 57435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatccacgtctcatcccctacctaccagcg

SEQ ID NO: 57436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatcctacggaggctcacagcggtgggtta

SEQ ID NO: 57437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatcgctttacgtgattatgggaattggac

SEQ ID NO: 57438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatcgtcaatcgacgcctgtcgaacgatgg

SEQ ID NO: 57439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatcgtggcatagtgtccctatatattcac

SEQ ID NO: 57440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatctaagtcgagccctggcaatcataccg

SEQ ID NO: 57441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatctagccctgtggactgctccttacacg

SEQ ID NO: 57442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatctgagcggctttcgtgtctgcattttt

SEQ ID NO: 57443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatcttaccgactttccgctacctcgcctg

SEQ ID NO: 57444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatctttttggtgatagtctaatggctctg

SEQ ID NO: 57445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgaggaatagtgtcgaaaatgcgatgct

SEQ ID NO: 57446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgagtgagcgacaacacgcgcgagaggg

SEQ ID NO: 57447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgatcgacacggcatgttgttaccacga

SEQ ID NO: 57448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgcagtgagttgtgtcgtggcgcactgc

SEQ ID NO: 57449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgcatgagctgctacacgggcatagcgg

SEQ ID NO: 57450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgccacacgatgcacggtgcaatgtgac

SEQ ID NO: 57451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgcgccgaattgaactcgttcttaatcg

SEQ ID NO: 57452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgcgggtatggcgacatttatgttctaa

SEQ ID NO: 57453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgcgttctggtgtcgacctgtaacctgg

SEQ ID NO: 57454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgcttgcagctctttatgggcccgatgt

SEQ ID NO: 57455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgctttgctatgttggagccggacatcc

SEQ ID NO: 57456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatggggagcggcatgggtctagctggcct

SEQ ID NO: 57457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgggtctatgaattacttccagtaacct

SEQ ID NO: 57458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgggtcttttggtactgttttttgtgat

SEQ ID NO: 57459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgggtgttcattgttgcagctagtaact

SEQ ID NO: 57460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatggtctgttcccgggtgtagttatgtag

SEQ ID NO: 57461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatgtacagatttggtcctccgtccctcct

SEQ ID NO: 57462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttattaatctatgctatccgtacggcgcgcg

SEQ ID NO: 57463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttattaccataaggcagtgattcgtatttag

SEQ ID NO: 57464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttattattattcctattgattttgtatgcgg

SEQ ID NO: 57465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttattgagccttatccagaaagtgcaccatt

SEQ ID NO: 57466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttattgaggactcgggccttctctcgcgtgt

SEQ ID NO: 57467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttattgaggtcgtttttcggatggtttcgtg

SEQ ID NO: 57468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatttacatcgaagaattcccgtgatgcgt

SEQ ID NO: 57469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatttaggattaccggtagtttgtatcgct

SEQ ID NO: 57470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatttaggttattctcgtcccgccgcgttt

SEQ ID NO: 57471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatttcactcacgggggtgctcttagctca

SEQ ID NO: 57472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatttccttcagctcgggctcttgtcgtca

SEQ ID NO: 57473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttatttcgtgtaaaagatttcagtatttgat

SEQ ID NO: 57474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaaacagaggtttaagttccaactcatac

SEQ ID NO: 57475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaacaaacccgtgaagtggcgagtcatct

SEQ ID NO: 57476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaacacaccgtctgatctgagaggtagtg

SEQ ID NO: 57477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaacaggggttatgtctgtagatgacagc

SEQ ID NO: 57478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaaccagcttcgtgccaattttctacaca

SEQ ID NO: 57479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaacgaaatcagaatgaggaagatagcgg

SEQ ID NO: 57480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaactgctcagaaaaaaggacctcagagg

SEQ ID NO: 57481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaagccgcaacctttagacgagcctcaat

SEQ ID NO: 57482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaagcgcaataaattgtccgtaaaccctt

SEQ ID NO: 57483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaagcgcgtactctgtttcatagcggtcg

SEQ ID NO: 57484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaaggactttgccctcacgcggttcggcg

SEQ ID NO: 57485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaagggggggtcagccacttgcgccttgt

SEQ ID NO: 57486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaagtggatcacctcgtagttgatgggcg

SEQ ID NO: 57487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaagttggcggcgcggtctttatattagg

SEQ ID NO: 57488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaagtttcgtgtatcaatttcgttcggac

SEQ ID NO: 57489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaatacctcaccgaaatgcaaagcaattg

SEQ ID NO: 57490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaatcgtgcggtccttcggcgcggcttta

SEQ ID NO: 57491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaatgccgtttagcgtccgaatgaggcca

SEQ ID NO: 57492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaatgggatctttttgggtgatttcatga

SEQ ID NO: 57493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacacatggctaaacgtgggaatcagaag

SEQ ID NO: 57494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacacgcgatcattttctcccagagcgtt

SEQ ID NO: 57495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacactggatagtggttcggtaggggagg

SEQ ID NO: 57496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacagctatcttgctcgtcctcctgcagc

SEQ ID NO: 57497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacatctactgattaaacaaggacaatat

SEQ ID NO: 57498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacatctgtattgtctccccacgtttacg

SEQ ID NO: 57499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacatggtaagttcaccgacgtatcgctt

SEQ ID NO: 57500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaccatgtgaaacacggaaaggatcaccc

SEQ ID NO: 57501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaccattgtttatggggtacggaagtgtc

SEQ ID NO: 57502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaccgcatgcaaggatgactaatcatggc

SEQ ID NO: 57503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacctacgggagtcaaagagtgttatcgc

SEQ ID NO: 57504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacctcctccaattgcccgcttctcgttc

SEQ ID NO: 57505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacctgacaacgacgaggcggtccagagt

SEQ ID NO: 57506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacgcgactagggttggggtcatctgtgt

SEQ ID NO: 57507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacggtgtacgtagactagtcccagctgc

SEQ ID NO: 57508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacgttatcaggcgtgcttcgtcaggtct

SEQ ID NO: 57509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacgttatgatacatcatcgtaggggaag

SEQ ID NO: 57510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcacgttgctcgaggcggagatctgtgtga

SEQ ID NO: 57511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcactgtttgcgtttgcacctcaagggcca

SEQ ID NO: 57512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcagaagcaaaacctccctgctcggtatgt

SEQ ID NO: 57513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcagaggagcccgcctcgggagtgtttggc

SEQ ID NO: 57514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcagagtataatgcggcaaggcattggagg

SEQ ID NO: 57515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcagatgtccttcttgtgcgtggactgctg

SEQ ID NO: 57516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcagcatactggtacgagccagcacgcgcg

SEQ ID NO: 57517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcagccatgatcgaggagcgttatatatgt

SEQ ID NO: 57518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcagcccggttaagatgacggctatacgac

SEQ ID NO: 57519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcagcttcatggattcaaccaggacgacat

SEQ ID NO: 57520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaggagaaagcgacctacaattctttatc

SEQ ID NO: 57521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaggatagacccatttgtacggaggccca

SEQ ID NO: 57522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaggcagctggtcgttaccggttttaccc

SEQ ID NO: 57523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaggccccacttacaagtatgatgctcat

SEQ ID NO: 57524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaggtggaggccgtcgtgagccttgccaa

SEQ ID NO: 57525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcaggtggttgctgtgtgtcttcttgttcg

SEQ ID NO: 57526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcagtggagggtggtttctgatcctttgcc

SEQ ID NO: 57527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcagtgggtcgcgcgtgcagtactggaatc

SEQ ID NO: 57528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcagtgttaaccccacggggcgctgcggtg

SEQ ID NO: 57529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcatacggcacacaaattccgcgctaggat

SEQ ID NO: 57530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcatagcttgctctgcgccgggagggaagc

SEQ ID NO: 57531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcatagttgggggtaataatggcaagtcgg

SEQ ID NO: 57532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcatatccctttgacgcgacgcgacttctg

SEQ ID NO: 57533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcatcatctggacgtgtcagggcgttgagc

SEQ ID NO: 57534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcatggaaagtatgcactagtcttgacctc

SEQ ID NO: 57535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcatgtaggggcgggcgtcgtagatttgtc

SEQ ID NO: 57536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcattaagggcttttgattgatagttcgcc

SEQ ID NO: 57537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcattgcgacaacgactgctgcaaggttgg

SEQ ID NO: 57538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcattgtgacgatccctggtgttaccctgg

SEQ ID NO: 57539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcatttccgtattactacttgtgtgcccgc

SEQ ID NO: 57540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccacacgccttttggcagcccaccagcat

SEQ ID NO: 57541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccaccaatgcaagtacaactgcattaccg

SEQ ID NO: 57542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccacgcaaatacccttctatcaccgtgcc

SEQ ID NO: 57543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccacggcctcctttacacgtggtgaagcg

SEQ ID NO: 57544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccagctgggagaacctgcctagtccacgc

SEQ ID NO: 57545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccagttactctatacccgctcttcacgta

SEQ ID NO: 57546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccatcacagcgtacagcgaccatccgaat

SEQ ID NO: 57547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccatggtccgacaatcataacccagtatc

SEQ ID NO: 57548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccattgggatgttctggttgtgtactggc

SEQ ID NO: 57549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccccaaccatgcctaatggaggtaaggcg

SEQ ID NO: 57550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcccccagtttgtccgatgcttccacaggg

SEQ ID NO: 57551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccccgaaacactatgtaatctgatgtgga

SEQ ID NO: 57552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccccgcgttcaaggtgcgcacgctccaga

SEQ ID NO: 57553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccccggcttttccattcctagttaaaccg

SEQ ID NO: 57554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccccttttggcgcaagtatgtatccggga

SEQ ID NO: 57555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcccgacaaatcggaggtctcatcccgaat

SEQ ID NO: 57556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcccgcacaagccggcctaggtttaacttg

SEQ ID NO: 57557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcccgttatctaattcttacggcgggacat

SEQ ID NO: 57558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcccgttttatgagagccggaattgtgcac

SEQ ID NO: 57559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcccttattacagttggtatgtgacgactt

SEQ ID NO: 57560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccgactgctgtttggtcggccgtcacgag

SEQ ID NO: 57561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccgagagctggttgtttgcggggcgctgc

SEQ ID NO: 57562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccgatcgacttgtttccgctctgtgtacc

SEQ ID NO: 57563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccgcaacatcatctttgactccgctcgtg

SEQ ID NO: 57564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccgccgaacgttctgtcttacttgtgttg

SEQ ID NO: 57565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccgcgcggggatgtttactactggttttg

SEQ ID NO: 57566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccggaacacaccagacatgccagcagaat

SEQ ID NO: 57567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccggactggttgtatagcatcccaggggc

SEQ ID NO: 57568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccggatcgtatcactagtcggggagcgtg

SEQ ID NO: 57569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccggatgacaagccgttttgggccagttt

SEQ ID NO: 57570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccggattcacgttaccacggctagccact

SEQ ID NO: 57571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccggcagccttggggtcgagccattcatt

SEQ ID NO: 57572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccggcctttaacctacatgtgaccaattt

SEQ ID NO: 57573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccggcgcagtatcgctcgatatgtctcaa

SEQ ID NO: 57574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccggctgcccacacatgaccggcgaagta

SEQ ID NO: 57575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccgggagcataccgttaggaagctttgtt

SEQ ID NO: 57576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccgggctccacatactgtcgtctcggtgt

SEQ ID NO: 57577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccggggaaaacggggccggttgtgtcctt

SEQ ID NO: 57578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccgtgcttcaatcagaagatcttgtggct

SEQ ID NO: 57579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccgtggataagcgttgatcggcggccgtt

SEQ ID NO: 57580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccgttcaggaatccggcggtctcctgcca

SEQ ID NO: 57581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcctacaggtaatgtagtagtagcgaatga

SEQ ID NO: 57582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcctactggtatgaggtgtggatcgaaggt

SEQ ID NO: 57583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcctaggtcggatcagatgctgacaggttc

SEQ ID NO: 57584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcctagtttacatctggagttgtgtaagtt

SEQ ID NO: 57585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcctatagcccacacccgttaaaaggtctt

SEQ ID NO: 57586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcctatggtagcttcagtggcggcgcgcga

SEQ ID NO: 57587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcctgcattagcctgcacaaactgggttgc

SEQ ID NO: 57588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcctgggggccgccgaactggtcgggcaga

SEQ ID NO: 57589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttccttagcatgtactggcaaaaccgcctta

SEQ ID NO: 57590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcctttgcgctcgacggtgcttaaatatcc

SEQ ID NO: 57591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgaacctttatttagaattggcatgcggt

SEQ ID NO: 57592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgaatatggggttggctaagcgttgagta

SEQ ID NO: 57593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgaatcggtctggtcgttcatcgagttgc

SEQ ID NO: 57594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgacgtgtggcacacttttcgatctgcgg

SEQ ID NO: 57595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgagaagggatttggttgttattctgtca

SEQ ID NO: 57596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgagagatcgcatactaggcttgatcgat

SEQ ID NO: 57597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgagagcgggtcccagtcacgggcatacc

SEQ ID NO: 57598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgaggcactgagacatccccactcctagg

SEQ ID NO: 57599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgaggggctgggggcgggatggacggtgc

SEQ ID NO: 57600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgaggtgccatttcaaagcgtcacagccc

SEQ ID NO: 57601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgatcagtcgcgtgtatcatcgataaacg

SEQ ID NO: 57602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgatcatatttcagccagacctcagtgtc

SEQ ID NO: 57603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgatcccgtgtagcgtcggctatggggtg

SEQ ID NO: 57604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgatgttgtccgtttatctggtcttcgac

SEQ ID NO: 57605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgcaacctaagggaggcaaactcttgacg

SEQ ID NO: 57606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgcagttttcacggacgggcattgggcca

SEQ ID NO: 57607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgcccagcggtggcctctccacaagtggc

SEQ ID NO: 57608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgcgcaatcagaggaggcaggttttgctg

SEQ ID NO: 57609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgcgcggcgttgaatgtcatgcggcacaa

SEQ ID NO: 57610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgcgcttacttgttgtgatccgtggcgct

SEQ ID NO: 57611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgcggactggtgcaaagacgaccctctgg

SEQ ID NO: 57612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgcgggttactgcagttcatttttcggcg

SEQ ID NO: 57613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgcgtgtgtggacgggtaatgtatgcgat

SEQ ID NO: 57614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgcgttggcttcttcaattctttctggtt

SEQ ID NO: 57615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgctattactttcggtcgcacgtccttat

SEQ ID NO: 57616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgctcagtcggcggtagtattagggacgt

SEQ ID NO: 57617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgctgggtgctttcaacagtcctacaacg

SEQ ID NO: 57618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgcttctctgacgtgccttgactttattg

SEQ ID NO: 57619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggaagttctatgctgtgaggtatgtgac

SEQ ID NO: 57620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggacgtctcgaggtatgtgaatcagggg

SEQ ID NO: 57621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggagcgagaacttgtttggcacagtctc

SEQ ID NO: 57622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggcaatttatccctcgatttacgcgcac

SEQ ID NO: 57623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggccgtggggtaccgccaatcactaaac

SEQ ID NO: 57624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggcctcgaccgtgatcgtcgtgactgtg

SEQ ID NO: 57625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggcgctgacgagttcggttcatatctgc

SEQ ID NO: 57626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggcgggagggctgggtaagcgtttggga

SEQ ID NO: 57627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggctcgcaggaccttgcggaggtggggg

SEQ ID NO: 57628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgggaactttttaagcgtgatgttacggt

SEQ ID NO: 57629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgggacgtctctttcttcattcccgggtg

SEQ ID NO: 57630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgggacttttgctgggtggaagtgatggt

SEQ ID NO: 57631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgggccagcttgtctatcaaacatttgcg

SEQ ID NO: 57632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgggcgacagtttgcatacgtcgactggt

SEQ ID NO: 57633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggggcgactggcctgctccatggcccca

SEQ ID NO: 57634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggggtacaaacgcaccagtgagttaagg

SEQ ID NO: 57635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggggtgctacttgttcgcagggtaggtc

SEQ ID NO: 57636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggtacgtgggaaacttaggccgccaacg

SEQ ID NO: 57637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggtcatcgccgagaaccgatcactcaag

SEQ ID NO: 57638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggtcctggttctaaattatctcagctga

SEQ ID NO: 57639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggtgagaacaggggtgtttccagttctt

SEQ ID NO: 57640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggtggaggctgcccccgctattgaatca

SEQ ID NO: 57641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggtgtgtgttctagtcgtccggcattgg

SEQ ID NO: 57642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggtgttttcatcaggtgggggctacacg

SEQ ID NO: 57643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcggttccggtcaccatgttcctctgtgcg

SEQ ID NO: 57644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtaaccagctttctctgttgtagtcgca

SEQ ID NO: 57645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtaagtcgatcgagacccaggtggcaac

SEQ ID NO: 57646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtacctcagaggttgagcgatttagccg

SEQ ID NO: 57647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtagcgatgtaccatgacatccgcgagg

SEQ ID NO: 57648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtagcggcccggtcctgcgctcattgcc

SEQ ID NO: 57649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtagctttaggacctttcggcaacttga

SEQ ID NO: 57650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtcatactgaaacgatctctgaaaggca

SEQ ID NO: 57651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtccagtgcgaagtatatcagactctca

SEQ ID NO: 57652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtcgtggcgcaatacgttcgcccaattc

SEQ ID NO: 57653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtctcgtgtggtaggctcgagttggcgg

SEQ ID NO: 57654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtgctactcattggcatacggcgcctcg

SEQ ID NO: 57655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtggaagtgtaggtgtatctgttgcatg

SEQ ID NO: 57656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtgggtcaccaggagtatcagtggaacc

SEQ ID NO: 57657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgtgttagctccctgtgatcttcgttggt

SEQ ID NO: 57658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgttccagcctacagaggaccgtccgcaa

SEQ ID NO: 57659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgttgaagatcgatccgggattatggagt

SEQ ID NO: 57660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcgttttcgccccccgtagtgtcacacatc

SEQ ID NO: 57661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctaagctagtacgcgccgattctggggga

SEQ ID NO: 57662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctaagctgcatctgattcaatgcgatgtt

SEQ ID NO: 57663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctaaggtatacaaggtggaccacgtcgtc

SEQ ID NO: 57664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctaatcacaacgtctgccgatgcctgaca

SEQ ID NO: 57665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctacactgacggactagtcattccgcgtc

SEQ ID NO: 57666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctaccgaagtgggtgtacttgggagggtc

SEQ ID NO: 57667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctaccgggcgagtttgtgcgtcatttcta

SEQ ID NO: 57668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctactatagtcttgcgtggctccagctcg

SEQ ID NO: 57669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctagctcttacttgtagaggtcctcgtga

SEQ ID NO: 57670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctaggcgagtgcgggttttgacactcttc

SEQ ID NO: 57671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctatggcacaccgtcttgagtttctcggg

SEQ ID NO: 57672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctattatcgcggttcctcgctgatagtgt

SEQ ID NO: 57673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctcaaacggcactataccttaccgggacg

SEQ ID NO: 57674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctcaaagcttagtcgtgattcgtttcttt

SEQ ID NO: 57675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctcagcgtgacagcacattcttttacatt

SEQ ID NO: 57676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctccaaaggtgtccgccacttctagtttc

SEQ ID NO: 57677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctccaaagtcacgccctcttggaacgcgg

SEQ ID NO: 57678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctccagtcgaccgctccatgcgcctctta

SEQ ID NO: 57679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctcccttcaggccccttcgaccacgatat

SEQ ID NO: 57680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctccgtcgggacacaggtaaggttgtagt

SEQ ID NO: 57681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctccgtgttggcaattaggggagtatttt

SEQ ID NO: 57682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctcctcgatcaatcgtaattcactgtact

SEQ ID NO: 57683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctcctgatcccttagcatatactgaaacg

SEQ ID NO: 57684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctcgcacggtcaatgcagttaagggttgt

SEQ ID NO: 57685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctcgggccatttccctcactacgaagttc

SEQ ID NO: 57686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctcgtccattggtaccagctgttacgaaa

SEQ ID NO: 57687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctcgtctattatttagggcactggcaaag

SEQ ID NO: 57688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctctaacagtgggcaatgcagtctgccat

SEQ ID NO: 57689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctctattacaggagagaaattctacaggc

SEQ ID NO: 57690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctgaagttctttcctttagtcctgccccc

SEQ ID NO: 57691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctgaatcaagctctctgatcttgttgctt

SEQ ID NO: 57692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctgagggtcggagcttcgcgactgtttag

SEQ ID NO: 57693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctgcaaggagcttaaccgaagagaaaggg

SEQ ID NO: 57694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctgccggggcaagtctctatgagctgtgg

SEQ ID NO: 57695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctgcctcgcctctttcgtcccctggtgtc

SEQ ID NO: 57696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctgcttcatgctcgagttggtcggccctg

SEQ ID NO: 57697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctggaaatctcgtcggcactgtttgtcgg

SEQ ID NO: 57698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctggacacttatctcacgctttctttaat

SEQ ID NO: 57699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctggcctttacggagattaacgattttcg

SEQ ID NO: 57700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctggctcttagtccgtgtgcgatggccat

SEQ ID NO: 57701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctggggaaaacgtgtgactctgattccta

SEQ ID NO: 57702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctggggggcaagtgtgcaacaaaaacgta

SEQ ID NO: 57703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctggtgatcgggcaggatgaaggtgacga

SEQ ID NO: 57704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctgtctgtgcaacggcagtttggtcccca

SEQ ID NO: 57705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctgtggagatggatgtgttgtctttttat

SEQ ID NO: 57706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctgtgttcgaattaagccccgcttttcgc

SEQ ID NO: 57707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttaaggttacaactcatccgcaattgtt

SEQ ID NO: 57708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttactgtgataacgtatcgtgtatcccg

SEQ ID NO: 57709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttaggaaacgtgttttgtgttgcccagg

SEQ ID NO: 57710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttcactcgagggcagttgtgttagtgtg

SEQ ID NO: 57711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttcagagcctgtctattatgtgtcttgt

SEQ ID NO: 57712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttccaagaggtaagtgcaagaaaaagag

SEQ ID NO: 57713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttccgcttttaaatacctttaccggacg

SEQ ID NO: 57714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttcgctcgaagtcgttcttgcatgtacg

SEQ ID NO: 57715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttgatgcatcggatcagtagtgtacctt

SEQ ID NO: 57716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttgatgtttccaatgtctgggggatgtt

SEQ ID NO: 57717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttgctatgtaccttgcggtttcgatacc

SEQ ID NO: 57718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttgttaacgtcccaaggattgtatggct

SEQ ID NO: 57719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctttattccgcgctactgattttagatgg

SEQ ID NO: 57720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttctttgggcacactcgtcttcgtggtgtct

SEQ ID NO: 57721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttcttttggttgatgctgtaaatcaatggga

SEQ ID NO: 57722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaaagcgcctcaccttccttactggtcgc

SEQ ID NO: 57723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaaatattgcacgtaggagttctcggact

SEQ ID NO: 57724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaacacgcctgctcccaggttgacgcccg

SEQ ID NO: 57725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaaccgggttcgtgcggctcagtcgggtt

SEQ ID NO: 57726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaactcgtaccacgtaaccaggggtaagc

SEQ ID NO: 57727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaagcggcattgtgccttacgcccgatct

SEQ ID NO: 57728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaatagcctttaggtatcggtcctcatcg

SEQ ID NO: 57729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaatgtgtgcttgttgtggccgctctata

SEQ ID NO: 57730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaattccgtgcctgtggtatttggggtgt

SEQ ID NO: 57731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacaaaggggacgaatccaaaagctggct

SEQ ID NO: 57732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacacaccgattttaaacctggtgatgat

SEQ ID NO: 57733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacactcggggactgtctctctgggtttt

SEQ ID NO: 57734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacactttaacgtcttaggcacgtttttc

SEQ ID NO: 57735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacagaggccgattctccggaactaggcg

SEQ ID NO: 57736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacagcacaggtgggggccgactacctgg

SEQ ID NO: 57737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaccacgtccgtagactgggggtttgcat

SEQ ID NO: 57738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaccactcattcgccgttcgctccatgtc

SEQ ID NO: 57739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaccacttggtacatctttacccttacga

SEQ ID NO: 57740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaccctcatggttattagggtgttttgat

SEQ ID NO: 57741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaccgaatagtatggggagtcccagtgcg

SEQ ID NO: 57742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaccgatggcgttcaaggtgacagcggtg

SEQ ID NO: 57743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaccttaattgagatccctctctcttgtg

SEQ ID NO: 57744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacgacacggcacaaggctttgtttaggt

SEQ ID NO: 57745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacgcgggtatttaccgagtcgtgtgtga

SEQ ID NO: 57746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacggaagcgtccggcgggtgatgcggta

SEQ ID NO: 57747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacgggcactgggggatccacctttgtaa

SEQ ID NO: 57748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacggtcaaactggcggtttgctcttcct

SEQ ID NO: 57749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgactaagtcccaaggaaaatttctggtgc

SEQ ID NO: 57750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgactcgattccggtcgaagttgatggctt

SEQ ID NO: 57751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgactgctacgcgtgttggatctgagcgtc

SEQ ID NO: 57752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgactggcttttcccaatctggttctcgat

SEQ ID NO: 57753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacttcttggttttgcctgggcatcagac

SEQ ID NO: 57754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgacttggatcgttcgagtgtctaggtctc

SEQ ID NO: 57755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgactttaattacttgggaggaaacaactg

SEQ ID NO: 57756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgagagtctggacgatacgccagaggttaa

SEQ ID NO: 57757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgagatggataggatcgacctgctcgggta

SEQ ID NO: 57758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgagccgaggagtctcggtagggatgttgc

SEQ ID NO: 57759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgagctattaaaccaaagcttagttatcta

SEQ ID NO: 57760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaggcgcaaccagtgggaatcatagggcg

SEQ ID NO: 57761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgagggaaggatcaagcggggtagtgttgg

SEQ ID NO: 57762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgagggacgtcaagatgcgtgtcccatatc

SEQ ID NO: 57763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgagggccttcgatggattatacggcgcgt

SEQ ID NO: 57764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgaggtcccggcagtagccctagtttctcg

SEQ ID NO: 57765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgagtaggtagcttcgagattcccgagagc

SEQ ID NO: 57766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgagtgacctgtccgccgtgtggttttgtt

SEQ ID NO: 57767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgatcgagttcgcactgtttgcatatcggg

SEQ ID NO: 57768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgatcgcccagatctttttatatcggcggg

SEQ ID NO: 57769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgatcgttcattagctggcaacgtcctcat

SEQ ID NO: 57770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgatggactggaaacactccacgcctgtca

SEQ ID NO: 57771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgattgcgcgtggtaacttcgcgtgctaag

SEQ ID NO: 57772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcaagtggtccctgtgctacacgtcagac

SEQ ID NO: 57773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcaatccaccgcaccgttacgcggtagac

SEQ ID NO: 57774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcacaatcgccttaagcgcgtaattcatt

SEQ ID NO: 57775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcacacaagcaatgctattccacacggcg

SEQ ID NO: 57776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcacacggccatcatactggagtggaacg

SEQ ID NO: 57777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcacactgggaaagatcttggggtggccg

SEQ ID NO: 57778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcacattcgcttttgccagagccacgggt

SEQ ID NO: 57779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcaccgttgtcacgacatgctcggtttgc

SEQ ID NO: 57780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcacgtttcggactctcctaggacatcac

SEQ ID NO: 57781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcactgattatactttgcgaacagcatgc

SEQ ID NO: 57782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcagatacggtgttttccgcggatcgggc

SEQ ID NO: 57783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcagcaacgacattgatacatggttaccg

SEQ ID NO: 57784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcagcccaagaaggtaagtcatcggcgac

SEQ ID NO: 57785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcagctatggaccaagccacgctagaacg

SEQ ID NO: 57786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcagtacagacttatcggcgggaccgggc

SEQ ID NO: 57787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcagtgttgagttagcgtaaccccaaatg

SEQ ID NO: 57788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcagtttctaattgctttcctcctggtgt

SEQ ID NO: 57789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcataaccagtgaatcctgcaaaccagag

SEQ ID NO: 57790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcattaacgtgagttcctaggatgaagga

SEQ ID NO: 57791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccaactcaatcccaaaacacatcagtgt

SEQ ID NO: 57792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccacgtttgtcggccgacggacggattg

SEQ ID NO: 57793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccagcagacagcttttgatcgtttggga

SEQ ID NO: 57794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccaggtgagcgattactttactatcaac

SEQ ID NO: 57795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccagtaccggttgcgcaccacgggcctg

SEQ ID NO: 57796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccatatgccggcaggacgggattccggg

SEQ ID NO: 57797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcccacgatataggccagtcttgcgtgcg

SEQ ID NO: 57798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccccgtgcctacggaaccgtgttttggc

SEQ ID NO: 57799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcccgcgcccaagtgaggtctggttagac

SEQ ID NO: 57800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccgcgagagtcaattttgaatggcaggg

SEQ ID NO: 57801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccggacaccatgtcgtatgcgagcgatt

SEQ ID NO: 57802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccggcaataggtgtacgttcgcacggtc

SEQ ID NO: 57803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccggtcgattctgcagtaatacactggc

SEQ ID NO: 57804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgccgtgcgatgtgtgtttaggttagcgtt

SEQ ID NO: 57805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcctaagtttaggtaggctcgggttagtg

SEQ ID NO: 57806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcctagcgcgatggatctgttgtctactt

SEQ ID NO: 57807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcctcactggcttaagattcgcgtatctt

SEQ ID NO: 57808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcctcagtcgatgctactcgcctatgggg

SEQ ID NO: 57809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcctcgtaactcaatcgacggatcttcct

SEQ ID NO: 57810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcctcgtcgggcttatttccgagctatgc

SEQ ID NO: 57811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgaccataatagtatcgcataagtggct

SEQ ID NO: 57812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgagatcggtatgatattgacgatggtt

SEQ ID NO: 57813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgatgccaatctaaggctcggaccgagt

SEQ ID NO: 57814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgatgggtgttaacaacacgggccaatc

SEQ ID NO: 57815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgatgttcacttctctggttccagcctt

SEQ ID NO: 57816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgcacatttggctttctacttgacgtgc

SEQ ID NO: 57817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgcagacaggtgaccgattgaatgacgc

SEQ ID NO: 57818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgctaggtgggcagggtcaaccgtaaac

SEQ ID NO: 57819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcggcgtgcaatgtagggttctaggtcgg

SEQ ID NO: 57820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgggactcggatgtgcattgatgggagg

SEQ ID NO: 57821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgggccataccacgcgacggggatttgt

SEQ ID NO: 57822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcggggcgtgatattcctacggagggcgg

SEQ ID NO: 57823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgggggaaacgagttgttccgggtcctg

SEQ ID NO: 57824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcggggttatagccgagtctggatagatc

SEQ ID NO: 57825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgggtaaatgaaattttaactcgtgcgc

SEQ ID NO: 57826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcggtctgcacatgcggtttgttcgtgga

SEQ ID NO: 57827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcggttgtatcctcgcgcattcgattttc

SEQ ID NO: 57828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgtgcagtttttcgggtgatgaatttct

SEQ ID NO: 57829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgtgcatgcagacgtgcggtcaagctgc

SEQ ID NO: 57830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgtggtaaagtaactacctcggttcggg

SEQ ID NO: 57831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgtgttcactctacactcgccttcagta

SEQ ID NO: 57832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgtgttgattaatacagtccagctcctt

SEQ ID NO: 57833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgttgggaccgacaacgttccgcatggg

SEQ ID NO: 57834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgttgggcccttattatgtgttgccacg

SEQ ID NO: 57835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcgtttgggagcttcgatgctcaatacgg

SEQ ID NO: 57836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctatctgcgccgagttcgccttcctggt

SEQ ID NO: 57837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctattcccggtttgacactggagcttac

SEQ ID NO: 57838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctcatggatacgggcattaacctagccg

SEQ ID NO: 57839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctcattgttcgtcatcatgtgcgcgtac

SEQ ID NO: 57840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctcgagcggggatccgagagactcttct

SEQ ID NO: 57841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctgaactcgcgtgggtgacggttcgcca

SEQ ID NO: 57842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctggcgggaagattattgactttgtata

SEQ ID NO: 57843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctggctcgcttggccgaggacgggttaa

SEQ ID NO: 57844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctggtaggaagagacgaagagagcactc

SEQ ID NO: 57845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctggttttaacgttggttgggctcctgc

SEQ ID NO: 57846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctgtctagcaacgacgcaaactgcaacg

SEQ ID NO: 57847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctgtctagggtctatcctcataaatctg

SEQ ID NO: 57848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctgtttctggcttagaacaatgccgtgc

SEQ ID NO: 57849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcttctcatcttcacatgcctgttgtcat

SEQ ID NO: 57850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgcttgacacattccacctgcagcacgacc

SEQ ID NO: 57851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgctttttacgcgtcccgtatctcggctga

SEQ ID NO: 57852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggaagagttgatttgtaagaggatcccgg

SEQ ID NO: 57853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggaaggggcttgatggggtgatgtgcacg

SEQ ID NO: 57854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggaaggttgttcagtgcccgacggcgtag

SEQ ID NO: 57855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggaccgccgaatgtgttgtcctcctcccg

SEQ ID NO: 57856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggactggtgagtccgtggtggcactgacg

SEQ ID NO: 57857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggagcaagctgtgatgggtatttcaagtc

SEQ ID NO: 57858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggagcgtgcgagtttggccaccgcacctg

SEQ ID NO: 57859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggagggagacagtcctggtaggcgcgtcg

SEQ ID NO: 57860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggaggtgctgctgacttttgtagtgatgc

SEQ ID NO: 57861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggagttggacacattacatgcaagcctgg

SEQ ID NO: 57862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcaacgggcagcgggcggtgctagctca

SEQ ID NO: 57863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcaccgggagaaactgtgttctttagga

SEQ ID NO: 57864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcacgcatcggctcggctcagtgtaact

SEQ ID NO: 57865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcacgccggcaaaatcagtagcgtcctc

SEQ ID NO: 57866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcagaaccgagacggtaaagggctgcct

SEQ ID NO: 57867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcagcgagcgactcgatcagctgggcgc

SEQ ID NO: 57868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggccagggtgaactacagttggtgcgtgc

SEQ ID NO: 57869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcccggcgttcccggagagcggtaggcc

SEQ ID NO: 57870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcccttggttacatgggggtatgtttga

SEQ ID NO: 57871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggccgattttccacatttaggggccaatt

SEQ ID NO: 57872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggccgcccttgtccattcttgtgcgagac

SEQ ID NO: 57873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggccggtgctcgttatagccttagcgtgt

SEQ ID NO: 57874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcctgcgagtgttgtagacggcgatacc

SEQ ID NO: 57875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcgccaagtgttggatctcaggcccccg

SEQ ID NO: 57876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcgccccagaagcgtcgaactgtctttg

SEQ ID NO: 57877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcgcgggtcaatttagcgaagtgggcgt

SEQ ID NO: 57878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcggcaaagccggagcttctatctggtc

SEQ ID NO: 57879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcggccagtcctggacgtggggaggtgc

SEQ ID NO: 57880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggcggtttcaagcgcctgctggccctcca

SEQ ID NO: 57881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggctacttgggatcctacagggaactatc

SEQ ID NO: 57882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggctagtcacacccgtcggatatcgtggc

SEQ ID NO: 57883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggctagtttatatcctgtttcctacgggt

SEQ ID NO: 57884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggctcctagctatacagggcagcctgggg

SEQ ID NO: 57885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggctgctgatagcactctctggctaccca

SEQ ID NO: 57886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggctttagcaaggatggattcatttacac

SEQ ID NO: 57887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggaagaccgccggtgagagtgtacctgt

SEQ ID NO: 57888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggactcttcgcggcaagaactgggataa

SEQ ID NO: 57889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggacttcctttgacgcgtaagggcgctg

SEQ ID NO: 57890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggatacgtgccagaaaggttgcccttcg

SEQ ID NO: 57891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggcaccggagcgtgttttaggcgacttg

SEQ ID NO: 57892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggcattaggcgaaagccagccccagtga

SEQ ID NO: 57893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggcccacctccgtttaaacgccaaaacg

SEQ ID NO: 57894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggcgaatttatgactggcggattggtta

SEQ ID NO: 57895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggctggtcttaactggtcttgtgtgttt

SEQ ID NO: 57896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggcttagtgggacttgaatgttcctgtc

SEQ ID NO: 57897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggctttgatccgatcggtactccttcgc

SEQ ID NO: 57898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggggatttctgatagacgtgttagtgtat

SEQ ID NO: 57899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggggccgagggtcatccggagacaggtcc

SEQ ID NO: 57900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggggctatcccactccagcacgaatttct

SEQ ID NO: 57901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggggcttggatgatctgtcagttacgagt

SEQ ID NO: 57902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggggcatgcttaattcccagtgacgact

SEQ ID NO: 57903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggggcgcttgtaagtgcatctgcttagt

SEQ ID NO: 57904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggggggactaagtctcgttgtaagcacta

SEQ ID NO: 57905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggggtcagccgtctcccccagtgtttggc

SEQ ID NO: 57906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggggtctgggccggaatcaagggttactg

SEQ ID NO: 57907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggtcgcattcaggacaccactcgattgg

SEQ ID NO: 57908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggtggagcgcgcgccttgccacgagctt

SEQ ID NO: 57909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggtgtattcgataacattacgtgtccgt

SEQ ID NO: 57910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggtgtgtgtttgagccggcggttgctgt

SEQ ID NO: 57911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggttctaacttgcggtggaagactgaag

SEQ ID NO: 57912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggttctcttactctatttgtcatctctg

SEQ ID NO: 57913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgggttttgtcatctgaagttttatcacga

SEQ ID NO: 57914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggtaccgactttactagccgcctgacgag

SEQ ID NO: 57915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggtaggatgcagatagttagctttggccg

SEQ ID NO: 57916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggtatcaccacctaggtatgtgggaccct

SEQ ID NO: 57917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggtcatcggccgtagtgcatatatagctt

SEQ ID NO: 57918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggtcgatataccatcctgatgggatcgat

SEQ ID NO: 57919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggtgcgaaacattcttatcatgaccagtg

SEQ ID NO: 57920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggtggagatttaatggtctggtgcggcgc

SEQ ID NO: 57921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggtggtggctttctcaagagcagttacgg

SEQ ID NO: 57922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggtgtgagccagtactcggggggtacgcg

SEQ ID NO: 57923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggtgtgggcgtagtcagtagggtccacgt

SEQ ID NO: 57924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttggttcggatcgcgacggccccagtagctg

SEQ ID NO: 57925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtaaagggcaccataggtacgtctctccc

SEQ ID NO: 57926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtaaagtcgcaagccatttaggagagtat

SEQ ID NO: 57927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtaacgctatcgctactcctctaaacgtt

SEQ ID NO: 57928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtaagaatttgtgactgcgcgtcaattat

SEQ ID NO: 57929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtaagcataacgagcgctactacggcagc

SEQ ID NO: 57930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtaaggcacagctatcaattttaattacg

SEQ ID NO: 57931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtaatggtccgtactgggtcaaccgggtg

SEQ ID NO: 57932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtagaacacagtcaattcagaacactgtc

SEQ ID NO: 57933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtagcctccacatatgcaccggtggtgac

SEQ ID NO: 57934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtagcctccgctgtgctcttggctctcct

SEQ ID NO: 57935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtagctttttcacaagtcaagtgtttaca

SEQ ID NO: 57936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtattaagcttccgtgtccgtctcttggg

SEQ ID NO: 57937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcacatgtggggacccgtatgcaaggca

SEQ ID NO: 57938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcaccatgcaaaatggaatccactttgt

SEQ ID NO: 57939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcaccggtaccggggcaaatggggctag

SEQ ID NO: 57940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcatgcgccaatttgggggtggagttga

SEQ ID NO: 57941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcattgattcatgtaacatctccaattc

SEQ ID NO: 57942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcccaagtagcgtatccgatctaattgc

SEQ ID NO: 57943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtccccaacttgcgacgtaagctgttttg

SEQ ID NO: 57944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtccgctcccctcccgctggattatgtac

SEQ ID NO: 57945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcgagggccccccgaacttgtcatcccg

SEQ ID NO: 57946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcggaacaattctacagtttgatccctg

SEQ ID NO: 57947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcggcccttgttgaggcactgcgttatt

SEQ ID NO: 57948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcggtacctctcccgagtgcacaattgg

SEQ ID NO: 57949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcggtcacgatctctagtggacggttcc

SEQ ID NO: 57950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtcgtgttgtgccttaccgacttgaggct

SEQ ID NO: 57951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtctatcggtcactatccttaaattcttc

SEQ ID NO: 57952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtctccatgtctagtgtaaccctcgacgc

SEQ ID NO: 57953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtctttccaggaccttcaattcactcgga

SEQ ID NO: 57954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgacactaaactcggcgtcttggtgtaa

SEQ ID NO: 57955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgacttcgtgtttacggacggcgccggc

SEQ ID NO: 57956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgagcctaaatttgtttaatagttgacg

SEQ ID NO: 57957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgatattcgtttggacgcacagtgctat

SEQ ID NO: 57958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgatcagcgtgcttcccgctaaagctta

SEQ ID NO: 57959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgatctgcttcgatgctttcgtgatctc

SEQ ID NO: 57960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgccaggtgaccttttgactgggccaat

SEQ ID NO: 57961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgccccggcaaagtgctcgcgcgcatga

SEQ ID NO: 57962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgcggcgaggtattccacttgctgtagg

SEQ ID NO: 57963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgcttacaaggacatctgccgttttcct

SEQ ID NO: 57964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgcttgtcacgccttgctgttgctgact

SEQ ID NO: 57965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtggatgaccttgtcggatcgcctatgcg

SEQ ID NO: 57966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtggctgaccgggttagaggcggtggcga

SEQ ID NO: 57967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgggcaaacgttgttcaacctgttagca

SEQ ID NO: 57968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgggttgtggggattacaggcggcacgg

SEQ ID NO: 57969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtggtgaaggataaatcttgacgtgggac

SEQ ID NO: 57970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtggtgccagccaagttttgtggcttatc

SEQ ID NO: 57971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtggtttgtctttagtcggcacctggacg

SEQ ID NO: 57972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgtcagtgcgccttctgctgcggtcatg

SEQ ID NO: 57973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtgtctattgcggcctactgttcggttgt

SEQ ID NO: 57974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttagaacactcgtcgttggtcgccaaac

SEQ ID NO: 57975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttatcacatcggacgcccacaccaagtc

SEQ ID NO: 57976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttatgggtgtcaaatagtatgcctctgg

SEQ ID NO: 57977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttccatgtatacaggatgcgttctgcgg

SEQ ID NO: 57978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttcgcacgatagcactaactttgggacg

SEQ ID NO: 57979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttcgtcgaacggacatgtgcaagtccta

SEQ ID NO: 57980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttcttgtaactggggatccgaggtggcg

SEQ ID NO: 57981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttgatgggcgttttcattcgtactcgtg

SEQ ID NO: 57982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttgcaccgttatgcttcattcacctgcg

SEQ ID NO: 57983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttgcggctccatggtatagaccaagttg

SEQ ID NO: 57984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttgtatgctccacgaggttcggtggtcg

SEQ ID NO: 57985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgttgtggccttaacggcggtgcgattgga

SEQ ID NO: 57986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtttaaaccgaatcggagttggatttcgc

SEQ ID NO: 57987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtttcaataagcggcactactgcgttgcg

SEQ ID NO: 57988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtttcgcgggcgattaccaatgcaccggt

SEQ ID NO: 57989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttgtttgtccatacgtcaactcgaggtacta

SEQ ID NO: 57990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaaagtttgttctggttcgaggtcaactt

SEQ ID NO: 57991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaaccgctctgtccggaggagccgggggc

SEQ ID NO: 57992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaagatttatccgtaattccgggcacgct

SEQ ID NO: 57993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaagcgtaaatgcgagggtttttgtagtt

SEQ ID NO: 57994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaaggctattatctcggggatatgtatct

SEQ ID NO: 57995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaagtggagcgtaattgttagcattcgtc

SEQ ID NO: 57996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaataggcagtaaaaggtgctgtttgcat

SEQ ID NO: 57997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaattctggatgatcctttccggagtcct

SEQ ID NO: 57998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaccgggggctatcctcatgttcagagat

SEQ ID NO: 57999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaccgtcgagtagcacggtacgagacagt

SEQ ID NO: 58000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttacgcgtacgaccgatctggtctagtaca

SEQ ID NO: 58001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttacggccgatcagtgcacacttcagccga

SEQ ID NO: 58002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttacggtctagggctgctatgtatgtcccc

SEQ ID NO: 58003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttactcattcattagatataggcacgtaca

SEQ ID NO: 58004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttacttgttgtacgcctggtagccacctgg

SEQ ID NO: 58005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttagagaattcagtggcttcatgaaatgtg

SEQ ID NO: 58006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttagagtcaatcaatctttggggggagcca

SEQ ID NO: 58007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttagatggaggtgcttctcaggcaactcca

SEQ ID NO: 58008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttagcggaggtttatgctctacattgggtt

SEQ ID NO: 58009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaggccgggagtggctgagcttgggaagt

SEQ ID NO: 58010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaggctcaatgtttttagcgaggcgcacc

SEQ ID NO: 58011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttagggtcaacaccgtaaccttgcttttat

SEQ ID NO: 58012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttaggtcttgctactcaatgagtggggtga

SEQ ID NO: 58013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttagtagatggtgccaatccgtcagatcgc

SEQ ID NO: 58014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttagtatttccacgctccgacggaaggtag

SEQ ID NO: 58015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttagtctagccgagccgacttagagcttcg

SEQ ID NO: 58016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttagtgaagaatggctggggttcccttgtc

SEQ ID NO: 58017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttagtgtaacgattgagtggaccaggaggc

SEQ ID NO: 58018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttataaagcgacgcctacttcagtgaactg

SEQ ID NO: 58019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttatacgtgtagaattcgctcagtttcctg

SEQ ID NO: 58020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttatatcattggtgaggtagttgcccttgg

SEQ ID NO: 58021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttatcaccaataacttatctagctacttgt

SEQ ID NO: 58022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttatcctggtaacataacgtacgtgggtcc

SEQ ID NO: 58023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttatctcagaaatattgcactaggcgagac

SEQ ID NO: 58024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttatgccattggatacgctgtgctgccagt

SEQ ID NO: 58025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttatggaggctagcaactagtccctcgcac

SEQ ID NO: 58026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttatgtcatctagtgtcgtttatacctgga

SEQ ID NO: 58027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttattgttctctgtccttgggaaaacactc

SEQ ID NO: 58028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcaacattacttcatctttgtcatgcgaa

SEQ ID NO: 58029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcaaggaggccacatcgggtgcgtgatgg

SEQ ID NO: 58030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcacagtgccaggtcgtgcctcctcgcct

SEQ ID NO: 58031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcacagttggttttggtaggcaggcaagc

SEQ ID NO: 58032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcacataggagggacagaaactaggggga

SEQ ID NO: 58033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcaccgccctatgaactcctaatgttcgc

SEQ ID NO: 58034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcacgagtgggctccgtatatgcgcttag

SEQ ID NO: 58035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcactgtttttgcggatcaggagttcggt

SEQ ID NO: 58036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcagaatgtcgtatgtgaggctcgtagag

SEQ ID NO: 58037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcagaccgggcggcttttgtatgttcttg

SEQ ID NO: 58038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcagggaacacttggtcgggcgttattct

SEQ ID NO: 58039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcagtctcataattattggcaatctcatg

SEQ ID NO: 58040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcatacgagatctggacataactaagctt

SEQ ID NO: 58041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcatccatccgtatcggacattgaacggg

SEQ ID NO: 58042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcatctgcccgcggagtgggtaccgtgaa

SEQ ID NO: 58043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccacaatgttactatcccgttgccaggc

SEQ ID NO: 58044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccatggatattgcacgagctacttcctg

SEQ ID NO: 58045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcccaagcgtgcaagaatcgtctttacca

SEQ ID NO: 58046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcccgaagacgaatgcgacagcgctcgcg

SEQ ID NO: 58047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccctgcacctgttacccctttggcgcgc

SEQ ID NO: 58048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccctgggtggagcaggaaagtgtggtca

SEQ ID NO: 58049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccgaagagtttgatgctcgggcagtttg

SEQ ID NO: 58050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccgacactaatacgtaaatctgatctgg

SEQ ID NO: 58051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccgatcgtattcgagttgggtctccatg

SEQ ID NO: 58052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccgccgaacagtatggacggagccattt

SEQ ID NO: 58053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccgccttcctcgagttcacagtggactg

SEQ ID NO: 58054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccgctaccacgtggtgcgttgtttggac

SEQ ID NO: 58055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccgcttggttaccaagactgccaatcgc

SEQ ID NO: 58056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccttatcgatgcttatgagccacgtccg

SEQ ID NO: 58057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttccttgggtgttagcgtgaattcggacgc

SEQ ID NO: 58058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcgaacagaccgttcgattacgatcatcg

SEQ ID NO: 58059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcgaccctcggttccgtctccctctagta

SEQ ID NO: 58060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcgaggtatcccgaattaatcacggggtc

SEQ ID NO: 58061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcgccgtaccccctagttccactatgccc

SEQ ID NO: 58062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcgcgacttcggttctgtaagggtgtcga

SEQ ID NO: 58063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcggaatagttgcgatctactctgttgaa

SEQ ID NO: 58064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcggactaccgaggatatgtcgagagcat

SEQ ID NO: 58065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcggagggacggtgcacacgtaacgtggt

SEQ ID NO: 58066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcggtatgtcgtccggatacaggctcgtt

SEQ ID NO: 58067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcggtcacgtcggaatggccaggtgagta

SEQ ID NO: 58068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttctagggcatgtttcagtgttgtcgtgtc

SEQ ID NO: 58069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttctccgtaggcttggcggctgtgcgatcc

SEQ ID NO: 58070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttctcgattggctggcatggtccacttttc

SEQ ID NO: 58071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttctcgggtgttgacttgaaatgcttgcct

SEQ ID NO: 58072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttctgaatagcttgccgtgccttcgctcgt

SEQ ID NO: 58073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttctgaggatccgggactggtgttgttcta

SEQ ID NO: 58074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttctggccttctattgcaaggacagagtcc

SEQ ID NO: 58075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttctgtgggtcacatgtcctgttaaggtct

SEQ ID NO: 58076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttctgttggcctcttggcttcctgttctac

SEQ ID NO: 58077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttctgtttgaaggcgacttaggttgtccgc

SEQ ID NO: 58078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcttaattattttctacctattaagcgta

SEQ ID NO: 58079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcttcgatctccgctatctacttaacatg

SEQ ID NO: 58080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcttcgctttgcgttcgtaccagttcttt

SEQ ID NO: 58081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcttgtaaacgagttttagattcgtgttg

SEQ ID NO: 58082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttctttatccctaccgcaccacatcgatcc

SEQ ID NO: 58083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttcttttccttccggggttgatcgatttgt

SEQ ID NO: 58084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgaacgatgttttggacagtgtgagagag

SEQ ID NO: 58085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgaacgctctgatcctgggacttcacggg

SEQ ID NO: 58086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgacctgcctagttttacactatccgccc

SEQ ID NO: 58087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgacgcacaggcgatcaagcggaaaccgg

SEQ ID NO: 58088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgacggcgcgtttagagacagatccagtg

SEQ ID NO: 58089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgactccatttagggaaccgtgtttgtgc

SEQ ID NO: 58090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgactgcggtagtcccaggcatgggagcg

SEQ ID NO: 58091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgagacatgtaggcccacacacagcggtt

SEQ ID NO: 58092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgagatcaatttctattgcttcagatcga

SEQ ID NO: 58093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgagcacggggacagaagtgcattccgct

SEQ ID NO: 58094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgagcaggacaagtgaattcttaaacggg

SEQ ID NO: 58095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgagggtccgttaataacttgtattggat

SEQ ID NO: 58096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgagggttgttgtgcgacgcggtagatcg

SEQ ID NO: 58097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgatccagtgccaggttctccaatctcac

SEQ ID NO: 58098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgatttccaccgcgctcgtactatttagt

SEQ ID NO: 58099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgcaatgtcatgcccttcggataactcgg

SEQ ID NO: 58100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgcacagccggggttttttggccgcaacc

SEQ ID NO: 58101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgcagccaaggtgtttcaacattgcgctg

SEQ ID NO: 58102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgcatggtagtgtgggggtcccggtacaa

SEQ ID NO: 58103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgccaagggagtagtgatgataagcgtaa

SEQ ID NO: 58104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgccagtgggctatctcgtccggttactt

SEQ ID NO: 58105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgccccaacagttacgcaataacgcgttg

SEQ ID NO: 58106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgccgaggccgtgtcattccgtaaactta

SEQ ID NO: 58107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgccgatagaccgggattccatgggcgtc

SEQ ID NO: 58108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgccgctgtaactgccgttgcactagtgg

SEQ ID NO: 58109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgccggacggttagggggctacgtggctg

SEQ ID NO: 58110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgccgggacgcgtctacgccgggattacc

SEQ ID NO: 58111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgccgtgacagactaacgggcgcgccatg

SEQ ID NO: 58112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgcctagtccgctctggtgtcagggatag

SEQ ID NO: 58113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgcgacagtcctagtacaatacactttga

SEQ ID NO: 58114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgcgagttcatttaccgtcctttgtctgg

SEQ ID NO: 58115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgcgatcttctagtgtctccagtctgcgt

SEQ ID NO: 58116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgcgattatggtgttagcaagtagtggta

SEQ ID NO: 58117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgcgcaacgtttcagacgggatctccagt

SEQ ID NO: 58118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgctaacaacttctgcctggtcgagactg

SEQ ID NO: 58119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgctcctgttggcttgtccgatcctgagc

SEQ ID NO: 58120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgctcttcccgtcccgcgcggcgcttttt

SEQ ID NO: 58121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttggatactgttgtttcgactgaagctgtg

SEQ ID NO: 58122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttggatttgtcttttacatcactcttgctt

SEQ ID NO: 58123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttggcagactctttgatactgggtgtgagc

SEQ ID NO: 58124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttggcctgcgatagcacatatcgttattat

SEQ ID NO: 58125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttggcctgttgcgggattcccatggtaact

SEQ ID NO: 58126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttggcgtaccggagcagcggtaccaggatg

SEQ ID NO: 58127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgggaccaagtcagtcctattttacggct

SEQ ID NO: 58128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgggcccggattagacttctctcactggc

SEQ ID NO: 58129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttggggatctactttcatgattgtgtgctc

SEQ ID NO: 58130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgggtataagcggctcttggttcaggacg

SEQ ID NO: 58131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttggttccatcagtattgatactgtccagg

SEQ ID NO: 58132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttggtttcggcagagcgcttatgcacgggg

SEQ ID NO: 58133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtaacttccccagagccttcaggacttc

SEQ ID NO: 58134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtacatcgcagaagtacagctgacgatg

SEQ ID NO: 58135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtaccgtctcggttgttatctagtgttc

SEQ ID NO: 58136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtagcgggcaatccaccgttctgatgca

SEQ ID NO: 58137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtatcaagacacaagggcaagagacagc

SEQ ID NO: 58138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtatgggcggtcgtactgataggtgttt

SEQ ID NO: 58139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtattagcatttggtgccccattcccta

SEQ ID NO: 58140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtattctgcattattagatttgtgtcga

SEQ ID NO: 58141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtcggactcctaggctgttctgctcgtg

SEQ ID NO: 58142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtgactaacctttggacgtccggaggga

SEQ ID NO: 58143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtggccgttgacctttaccgattcggcg

SEQ ID NO: 58144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtggggcaaaccaaggtaggtagtgctg

SEQ ID NO: 58145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtgtggtgctgcgctcttcttcgccatg

SEQ ID NO: 58146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtgtgtggcggaattaatctttactcgc

SEQ ID NO: 58147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtgttgttctttcaccccctactcgctc

SEQ ID NO: 58148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgttaatacctttgatcacgttagttcgc

SEQ ID NO: 58149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgttcggcagagatggtcgcgctataata

SEQ ID NO: 58150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtttcccagatgactccttacctcaccg

SEQ ID NO: 58151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgtttgtgagataagcgattatataaacg

SEQ ID NO: 58152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttgttttccgaaaaatcacaagagtagtgg

SEQ ID NO: 58153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttaaagtcgcgtgcatcggtttgagttta

SEQ ID NO: 58154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttaacaagttttctcgccaccatgctcga

SEQ ID NO: 58155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttaacataggcttacacctttgcccgctc

SEQ ID NO: 58156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttaactcaaatgcgttaatcttgtcggtg

SEQ ID NO: 58157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttaatcgccggattcgaatcttggtcgtg

SEQ ID NO: 58158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttaggacgtgatcaatttcgaacatggac

SEQ ID NO: 58159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttaggggtacgggacgctgtgaactcccg

SEQ ID NO: 58160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttagtgaacggatcgtgtgaacgccatag

SEQ ID NO: 58161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttatcgtggtctggcctgaactactcagc

SEQ ID NO: 58162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttcataaatagttagtatcagtggttttt

SEQ ID NO: 58163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttcattaggtcgtggcatagtggggagcg

SEQ ID NO: 58164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttccagcacagaatctttttacgactctc

SEQ ID NO: 58165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttccaggtgtgcctaggccacgactgacg

SEQ ID NO: 58166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttccccccagttggcatctctagcgtgtt

SEQ ID NO: 58167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttccccggctcgattcgaagcgcacaatg

SEQ ID NO: 58168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttccgtgataccgggaggtcgctgaggcc

SEQ ID NO: 58169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttcgacctcgacaagtcatcatcacgtgt

SEQ ID NO: 58170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttcggacataagcttgaagaattggcaga

SEQ ID NO: 58171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttcgggcgaattagatcctccgttgcccg

SEQ ID NO: 58172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttctcggtatcgcacggtacttttgggga

SEQ ID NO: 58173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttctgggtaattgatatgttgttcagctg

SEQ ID NO: 58174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttctgttgggtgtgtgttcaacgaggaat

SEQ ID NO: 58175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttgaaggtatatttgtcagcgtaggggga

SEQ ID NO: 58176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttgacggggcgcatggctcagtttgtggg

SEQ ID NO: 58177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttgaggtcccgcaggtttacgctgaattt

SEQ ID NO: 58178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttgatgtcgcacggtccttaagtgatttt

SEQ ID NO: 58179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttgccaactcccagtttccgtacgtccgc

SEQ ID NO: 58180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttgcgtcatgaatgggaagtgcccgcacg

SEQ ID NO: 58181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttgctcaatacggttttatcaagcattgt

SEQ ID NO: 58182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttggccatgaaactacggcaccgttggtg

SEQ ID NO: 58183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttggcccattatgacagtgcaaattgcga

SEQ ID NO: 58184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttggtgcctgggggcaatgtatctagtta

SEQ ID NO: 58185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttggttaggtcgaagttttacgcgggccc

SEQ ID NO: 58186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttgtactatggaatttactttaaagacgt

SEQ ID NO: 58187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttgtaggagttgtttaaataattgtagtt

SEQ ID NO: 58188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttgtgatggagagttaaatgggtacggat

SEQ ID NO: 58189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gttttgttaggttaccgacaaggaggcggggg

SEQ ID NO: 58190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttttaaagacttcggggggaccggctacct

SEQ ID NO: 58191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttttactgtctgtcatctggccttacatat

SEQ ID NO: 58192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttttcagtgaagcagtgttgcaatggtagc

SEQ ID NO: 58193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttttccgtagttcagtcgatgcctcctggt

SEQ ID NO: 58194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttttcgggttggtactatgagccggcttgc

SEQ ID NO: 58195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttttcgtactcgcggtgctctttatcccga

SEQ ID NO: 58196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttttgactaaccggtgcgtatggtactgta

SEQ ID NO: 58197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttttggactgagtaactgcgaggacggcaa

SEQ ID NO: 58198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gtttttgtcgacagctgcagtcctcaaccccg

SEQ ID NO: 58199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaaaataaatcaccggtacacttgacattt

SEQ ID NO: 58200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaaaatgcgctttcactccggattaaattg

SEQ ID NO: 58201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaaatacaagtagtacgacccgctctgtct

SEQ ID NO: 58202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaaatgtgaagctagggtacgacagtggaa

SEQ ID NO: 58203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaaattctggagattgtgtttctgcgatag

SEQ ID NO: 58204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaacaacgtcttgtgttttataattctgat

SEQ ID NO: 58205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaacccgcgcgaaagaggtgccccacgtgt

SEQ ID NO: 58206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaaccgaaactggatgtagttaatatgtcg

SEQ ID NO: 58207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaacctgctgtaacatgggtatgcggtgca

SEQ ID NO: 58208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaaccttcaggggaggacggcgggtctcac

SEQ ID NO: 58209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaaccttccaacatcaagccaggtcttgcg

SEQ ID NO: 58210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaaccttcctcgcccgtctgcggcattggt

SEQ ID NO: 58211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaactgccggtatcctcagaagtttccagc

SEQ ID NO: 58212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaagaacctggacgggcatatcatatcgga

SEQ ID NO: 58213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaagatgtggaatagtcgggcgcgaatgtg

SEQ ID NO: 58214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaagcaagcaggcaactttcacttctcgag

SEQ ID NO: 58215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaagccaagaactctgtgactcctttggaa

SEQ ID NO: 58216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaagcgcagcgatcattcgatgcatatgta

SEQ ID NO: 58217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaagcggctacactacagttctcggtctgc

SEQ ID NO: 58218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaaggataagttcttttgatctcggtaatg

SEQ ID NO: 58219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaagggatctccttctgcctgcagggaacg

SEQ ID NO: 58220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaagggcaacgttagggatagtcacacgcc

SEQ ID NO: 58221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaagtaaggatatcttggactacttgcata

SEQ ID NO: 58222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaatactccaatctacttgacgttgactga

SEQ ID NO: 58223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaatctacctgtatgatctatgtggattgg

SEQ ID NO: 58224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaattcatatgttaacatctgtcaaagcta

SEQ ID NO: 58225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacaagacatttaaccttcggtctccgtac

SEQ ID NO: 58226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacaagtcagcctactgtgtggtggatggg

SEQ ID NO: 58227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacaatgttaaccgaagatcaaaggggaag

SEQ ID NO: 58228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacaccatgctggctattaggtacccaccc

SEQ ID NO: 58229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacacgcatacaatatggccgcgtaatact

SEQ ID NO: 58230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacactgtgatctgtcggttcttggtggtt

SEQ ID NO: 58231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacagaactatcagacctgcttgatactcg

SEQ ID NO: 58232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacaggttatggcccgcgttagtaggttat

SEQ ID NO: 58233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacatacgttaaaagctaatctaacaaggc

SEQ ID NO: 58234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacatccgtgcaccccgtatctactagtcc

SEQ ID NO: 58235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacattttcccgcactactgaggcgagggc

SEQ ID NO: 58236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccaacagtaccacgctattgtcggtcat

SEQ ID NO: 58237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccattctttgggcttgttcccgtaagac

SEQ ID NO: 58238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacccaaagctacgccgtcttgcttcacat

SEQ ID NO: 58239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccccgggcgaaagacccctgcgggtggg

SEQ ID NO: 58240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccgatcttgtttatgccgtatgattcta

SEQ ID NO: 58241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccgatggagctgccccataatctacggg

SEQ ID NO: 58242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccgcggtcttcgatggcactgaacgtgg

SEQ ID NO: 58243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccggccctaaaacatcgcagcgggtctt

SEQ ID NO: 58244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccgggaaggtgacgtagaaaatgcgatg

SEQ ID NO: 58245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccgggcaagacgaacgtaggagggatta

SEQ ID NO: 58246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccggggaacataaatctttccggttggg

SEQ ID NO: 58247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccgtaggcttcatcgattgcgtctttgc

SEQ ID NO: 58248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccgtcgaatctcgactatttgcggcctc

SEQ ID NO: 58249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccgtttcttatagttcggtgttaatcta

SEQ ID NO: 58250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacctacacccggagttagtctctcgcggc

SEQ ID NO: 58251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacctcagttgggactttaacgttcccgtt

SEQ ID NO: 58252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaccttggccaaccgtctcggaacctggat

SEQ ID NO: 58253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacgaaccacgtattcaatggtagcactag

SEQ ID NO: 58254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacgaacgagtccacgtgtcactctcattg

SEQ ID NO: 58255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacgacgcagcatcgggagtttaaccatag

SEQ ID NO: 58256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacgcacgacgtgacggcattcgctagtgg

SEQ ID NO: 58257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacggacgactccccgggggaaatcctttc

SEQ ID NO: 58258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacggccaacagcaatggtcgcgccttatg

SEQ ID NO: 58259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacggtgttgtggcactcttgctgtagcca

SEQ ID NO: 58260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacgtgcgattcgcggatttaggccatttg

SEQ ID NO: 58261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaacgttatgctctgccactattggcgttag

SEQ ID NO: 58262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaactaaactaggttaatggtcacggatcca

SEQ ID NO: 58263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaactattgaatatcgcacgatccatttgcc

SEQ ID NO: 58264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaactcgtaaagtcaaggttgctgtcttaag

SEQ ID NO: 58265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaactgatctggtgggtccattgcctgaccg

SEQ ID NO: 58266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaactgccgagaagtgttggtattacttgtg

SEQ ID NO: 58267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaactggcattatcccggtatttccgcgtct

SEQ ID NO: 58268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaactgttctcggggtagtgagtacgtagag

SEQ ID NO: 58269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagaaggagatcctgttgctttcgtcggcg

SEQ ID NO: 58270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagaattgattttgtgtgctggtcccttat

SEQ ID NO: 58271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagactactgtggtgagagactatcggtaa

SEQ ID NO: 58272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagagcgtggttttcgattgtttgattctg

SEQ ID NO: 58273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagagctattgactgtcctgatttatgtcc

SEQ ID NO: 58274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagatcgtaacatcgttttaatttacgttc

SEQ ID NO: 58275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagcacaacagatacgctcttggaggcgcc

SEQ ID NO: 58276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagcacaggttccctagtaggtggggtacg

SEQ ID NO: 58277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagcatagattaactccatgcacacgggtg

SEQ ID NO: 58278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagcctcgttccgtccaatgatcctaatgg

SEQ ID NO: 58279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagcgggcagggcgtccgtcaccggacagt

SEQ ID NO: 58280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagcggtgatccgagcttcgcttgtacgaa

SEQ ID NO: 58281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagcgtgcctgggctttgggaatgtatcgt

SEQ ID NO: 58282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagctgcgagaaatgtgggtgtcaaaatgc

SEQ ID NO: 58283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagctgtaattgtcctgggcaccttagaaa

SEQ ID NO: 58284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagctgtgcagagagtacctgcttgagggc

SEQ ID NO: 58285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagctttaatactgtggccatgtaagtctt

SEQ ID NO: 58286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggacatgcttcgagccggtctcctttat

SEQ ID NO: 58287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggacgggtggtggttgtacttttgtcta

SEQ ID NO: 58288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggagcagctagagtctagaggtgagggg

SEQ ID NO: 58289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggagcgggcgtcgttctcaggtccagag

SEQ ID NO: 58290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggagttgcgcaatttgctctgcagcggc

SEQ ID NO: 58291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggatgtactacacggtagtatttagagt

SEQ ID NO: 58292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggcaagggatgcaagcgggagcatcgta

SEQ ID NO: 58293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggcactcggctatgccatatcggtggcg

SEQ ID NO: 58294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggccggtgctagtctggtgccttattgc

SEQ ID NO: 58295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggcctgcccgggttccagtctcaagccg

SEQ ID NO: 58296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggcgcctccgtggtgttgatgaagtgcc

SEQ ID NO: 58297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagggatcggttagcggcgactttaaacgg

SEQ ID NO: 58298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagggggtagttaggcataggtctccaggg

SEQ ID NO: 58299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagggtgtaccatagggggagtgattatac

SEQ ID NO: 58300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggtcgactctagttttatagaggatccg

SEQ ID NO: 58301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggtctagcttattcatacatactcttac

SEQ ID NO: 58302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaaggttaagagttggtcaaggtgtttacga

SEQ ID NO: 58303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagtacaggtacgatgaggtaattgcacga

SEQ ID NO: 58304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagtacggcattccacggtgcacaacgccg

SEQ ID NO: 58305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagtccctatattgtgtaaaagaagccggc

SEQ ID NO: 58306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagtggtgtttagggtcagatccaataagg

SEQ ID NO: 58307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagtgtgcggcatataatgtcctctccttc

SEQ ID NO: 58308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagttcaaagggtcgttatctaggaaggta

SEQ ID NO: 58309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagttggtatagtgacccaattttttctga

SEQ ID NO: 58310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaagtttgctgcggctcgagagtgtctgtgg

SEQ ID NO: 58311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaataactctgggcctattggcgcgtatcga

SEQ ID NO: 58312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatactaggttcaacgtcactttagttgag

SEQ ID NO: 58313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatagtatccctgactattaagagcccggg

SEQ ID NO: 58314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatatgactttcgggctccgtatgtggttg

SEQ ID NO: 58315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatccacttctagacagttttacgaatgga

SEQ ID NO: 58316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatcgcacaggtcggtatctcgcagcatca

SEQ ID NO: 58317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatcgtgaaatgcggtggcctgtacatatc

SEQ ID NO: 58318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatcgttgacgaatttaacttgttcaaaac

SEQ ID NO: 58319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatctgcggtttagtggtcactgcgggacg

SEQ ID NO: 58320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatcttgccgctagtgcagtttagggtagg

SEQ ID NO: 58321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatgcactggatgtgtttcgtatgcgatcg

SEQ ID NO: 58322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatgcagtatcagcttgtgttacacgattc

SEQ ID NO: 58323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatgcgaatgaatagacttatcatacgaac

SEQ ID NO: 58324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatgggcctctgtttgatgcgatgcgcgct

SEQ ID NO: 58325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatgtggaagttagccataatctgtcgctg

SEQ ID NO: 58326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaattaaactcggggttgcggtggcacaagc

SEQ ID NO: 58327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaattaaatttcccgtctcttgtcacgttta

SEQ ID NO: 58328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaattcgctggtggttgtctgtatgtgtagt

SEQ ID NO: 58329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatttctgccccggcacttctgatcaagtg

SEQ ID NO: 58330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaattttgtcaatttaaagtggggtgttgct

SEQ ID NO: 58331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaatttttcttggataatttcgtgctcacct

SEQ ID NO: 58332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaaaaatcgctagggatgtgcccagttgc

SEQ ID NO: 58333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaaacgacattactttcccttggcggtat

SEQ ID NO: 58334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaaagtgtatgggaatagcagtgacctgg

SEQ ID NO: 58335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaacacagtcaggttgatctatactatcg

SEQ ID NO: 58336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaacacccctcctctactctgctggattt

SEQ ID NO: 58337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaacgcttcgggcaggacagcacaccgcg

SEQ ID NO: 58338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaagggaggatatcgcaggatggcaacgg

SEQ ID NO: 58339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaagggcgttacatacgttgaaagcgctg

SEQ ID NO: 58340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaagtaccagccaaggcagcgataggcac

SEQ ID NO: 58341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaatagcggcgacgggcgttcggctgttg

SEQ ID NO: 58342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaatcttcttttgaatttcacggatttgt

SEQ ID NO: 58343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacacaaacccaccgttcttctaattttcaa

SEQ ID NO: 58344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacacaactatctcccaccgggctgttaact

SEQ ID NO: 58345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacacagtcagttgtattggctcgctcggcg

SEQ ID NO: 58346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacacctcacgtgtataccgattgtaaagct

SEQ ID NO: 58347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacacctcccgctggcagacgttcgtctccg

SEQ ID NO: 58348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaccttggggccagtgcagttagggaggt

SEQ ID NO: 58349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacacgagcgataaaagtctaaggtgacatg

SEQ ID NO: 58350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacacgagtatcgtttggatgttctgcccca

SEQ ID NO: 58351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacacgcatgttacgggcaaatcagtcatgg

SEQ ID NO: 58352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacacgttccgtttctatggtctgtagccgg

SEQ ID NO: 58353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacactcaagcccgcggtacaacgagacaac

SEQ ID NO: 58354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacagaggctcccgggcagacttctacgatt

SEQ ID NO: 58355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacagatcgatgagtggctacggccgagggt

SEQ ID NO: 58356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacagcaagttaggccccggcacagctagaa

SEQ ID NO: 58357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacagcaatgcgggtaattgtaagcccactg

SEQ ID NO: 58358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacagcgataagtgcgatccacccgtccgcc

SEQ ID NO: 58359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacagcgcggcaccatcagatcccccggcca

SEQ ID NO: 58360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaggataacccgcgttttagatggtaccg

SEQ ID NO: 58361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacaggtttctgtagatgttgcattcggatc

SEQ ID NO: 58362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacatactgttggcgtgaatcctgtttgggg

SEQ ID NO: 58363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacatgcccccggatttcgactttacattca

SEQ ID NO: 58364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacattagtggacttgaaggacttcgaacgc

SEQ ID NO: 58365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacatttaatgttaagttaagcggtggtgac

SEQ ID NO: 58366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccaaccgagggcgtggattatgctggagg

SEQ ID NO: 58367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccaacgctaggcttcaggaggatcatttc

SEQ ID NO: 58368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccacctgttgacgaggcgcatgcccttag

SEQ ID NO: 58369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccactccccatacccggttgggcgatgcg

SEQ ID NO: 58370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccacttggcttgacactcgagttgttttc

SEQ ID NO: 58371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccagatttaggattgctatacttgcattt

SEQ ID NO: 58372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccattttgatgggagtttactccgtgtta

SEQ ID NO: 58373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacccaagcgctgccagctttttatgggcgt

SEQ ID NO: 58374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacccaagtgtacattcctagaagccggttt

SEQ ID NO: 58375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacccattgcgcaacacattaattgctaggc

SEQ ID NO: 58376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacccgataacataacgtacgtgctggcttg

SEQ ID NO: 58377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacccgccgaggtatagtggccacaaacgcg

SEQ ID NO: 58378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacccggcgtctttctgttcgacatcgcttc

SEQ ID NO: 58379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacccgtacttattggtttggtgtctgagtc

SEQ ID NO: 58380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccctcgcttacaaacagctggctgagcgt

SEQ ID NO: 58381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccctcgggacatagatgcactttggtgag

SEQ ID NO: 58382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgaactcagggggactttccgggccatc

SEQ ID NO: 58383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgagacgggatcctttcctaaacgattt

SEQ ID NO: 58384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgagcaggggtctgtgatgcttacctac

SEQ ID NO: 58385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgagggcacgggggcatagtttgaggtc

SEQ ID NO: 58386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgcacttgccattgcgtcgcgggtacgg

SEQ ID NO: 58387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgcagccttaaaacatgcgcgcccagtg

SEQ ID NO: 58388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgcagttccccccgcggcatttaattgt

SEQ ID NO: 58389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgccgcctgagtacacgctaatttcggt

SEQ ID NO: 58390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgcgcccgatcaacctcacactagttgg

SEQ ID NO: 58391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgctatacactaaagcattatacatggg

SEQ ID NO: 58392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgcttagcctagttactgttcagccttc

SEQ ID NO: 58393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccggacggggaagggtttgctgctctggc

SEQ ID NO: 58394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccggcaagattttccgtggtatagagttc

SEQ ID NO: 58395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccggcccgtgcgtgtgttattctgcccac

SEQ ID NO: 58396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccggcgacagtctgcattcatcccaacca

SEQ ID NO: 58397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgggatattgggagaacacaggaagtgt

SEQ ID NO: 58398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgggcagtcttttgcgctttgcggcgtg

SEQ ID NO: 58399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccggtgtattacatccttagagacaaacc

SEQ ID NO: 58400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccggtttccagatacaatagcatgcctga

SEQ ID NO: 58401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgtatccttctttaatcttaatggtcgg

SEQ ID NO: 58402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgtcactggctaggtgatgcaggtcgga

SEQ ID NO: 58403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgtcgtgcgttactctgatagggtctgt

SEQ ID NO: 58404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgtgaaactctgcatgggccagctgaat

SEQ ID NO: 58405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgtgctatttctagggtccttgataccg

SEQ ID NO: 58406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccgtgtgaggcgttcttattattctcgcc

SEQ ID NO: 58407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacctactcctgcccacgaacagtcgagtcg

SEQ ID NO: 58408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacctactttcccggggatgcaagggatgtg

SEQ ID NO: 58409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacctcaccgctcatccaattagctcaagcg

SEQ ID NO: 58410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacctcctggcgcgttctcggcatgacggtg

SEQ ID NO: 58411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacctcgaggctctaatcccttaacccttac

SEQ ID NO: 58412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacctcggtttcgtccattcggcgtaaatca

SEQ ID NO: 58413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacctgatagcttaacgtaattctgggcgct

SEQ ID NO: 58414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacctgctagcataaccaccgcagatacctc

SEQ ID NO: 58415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccttcacccgggaaatttatcgtcacctg

SEQ ID NO: 58416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaccttcctgcaccgtgttcttgccggttcc

SEQ ID NO: 58417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgaacaactatgggtgcacgagattacgc

SEQ ID NO: 58418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgaacctccatcggcggatccctcaaggg

SEQ ID NO: 58419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgaacgctggacctcgccaccggtacgtg

SEQ ID NO: 58420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgaacggtcgcgggaatccgatcacgggc

SEQ ID NO: 58421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgacaaggcgaagggactatgatgtctat

SEQ ID NO: 58422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgacatgttgtgctcttcgagttcctggt

SEQ ID NO: 58423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgaccaagccgcgtcccgccatcatgcgc

SEQ ID NO: 58424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgaggttagctggtgcgagtttatgggcc

SEQ ID NO: 58425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgagtcacacagactttcgatttggaggc

SEQ ID NO: 58426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgatgggggatgcaaatctgtatacgacc

SEQ ID NO: 58427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcacgaagaagatctgctccgagccact

SEQ ID NO: 58428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgccatacgattacacttacacgccgtaa

SEQ ID NO: 58429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgccgacccgttcgtggatcacaatccgt

SEQ ID NO: 58430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgaaccggacggccatgcaggattaca

SEQ ID NO: 58431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgagtcagggttttactggaccgtaga

SEQ ID NO: 58432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgccacctagcattctgttgcgtccgg

SEQ ID NO: 58433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgcctttaatgaatgaggttgagattg

SEQ ID NO: 58434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgcgccgaattctcacatggcccctat

SEQ ID NO: 58435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgcggcccgtatagtgcgtacagactc

SEQ ID NO: 58436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgcgggcacgtgcttacaaccggcttc

SEQ ID NO: 58437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgggcaccagaaccggcctggccactc

SEQ ID NO: 58438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcggtactgaaggtcagagctgttcctc

SEQ ID NO: 58439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgtccgacattaccgaacatgcatgta

SEQ ID NO: 58440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgtggctgcgtccgtaatatcaaagcg

SEQ ID NO: 58441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgttagtgcacccgttacgtaaagtcg

SEQ ID NO: 58442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcgttattctaagattggtttactccac

SEQ ID NO: 58443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgctagaccccccctggtccccgtcaact

SEQ ID NO: 58444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgctagaggctggctagctggggttatcg

SEQ ID NO: 58445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgctgcactcgtaaggggctcctgggttg

SEQ ID NO: 58446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgcttggggtagtctctccattatgggag

SEQ ID NO: 58447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggataggagtcgggcttagtcgagcgtt

SEQ ID NO: 58448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggcccggtcagtgcggtagctcatcaac

SEQ ID NO: 58449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggcgcagatgaacgatggcctaacattg

SEQ ID NO: 58450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggcgtgtgtgtcaggtccgattcactac

SEQ ID NO: 58451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggctctgtacatccgtaggctcgtgcat

SEQ ID NO: 58452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgggaacctccgcatgaattaatttagcg

SEQ ID NO: 58453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgggcagccgcaccttaggcctgagtggg

SEQ ID NO: 58454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgggccctcttttgtacggcatgaggtcg

SEQ ID NO: 58455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgggccgtggaggtcgacgcgtaatgagt

SEQ ID NO: 58456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggggggttggatctgaacctgcgttttc

SEQ ID NO: 58457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggtagtcctaaggtttggttggtctaac

SEQ ID NO: 58458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggtatttcaagctatatgagagggggtg

SEQ ID NO: 58459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggtcaacatgcttctggggtcaatcagt

SEQ ID NO: 58460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggtcactgctaggcaacatcggcggacg

SEQ ID NO: 58461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggtcggatctagtttaggatgtgtagcg

SEQ ID NO: 58462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggtggcagtcactgttcatgagttggtt

SEQ ID NO: 58463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggttaggttataacaatgtccgaatatc

SEQ ID NO: 58464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacggtttctcttaggcaattgtgccgagct

SEQ ID NO: 58465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgtaacttttggataagctctccaatgct

SEQ ID NO: 58466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgtagtccatccagggcagtgacatctat

SEQ ID NO: 58467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgtcaagttcgtctcggagggggttcgag

SEQ ID NO: 58468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgtggacatgcgtttgtaagctcattgta

SEQ ID NO: 58469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgtggatagaatgaccacacaggtacgtg

SEQ ID NO: 58470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgtggcggcatcccgcgtctcggctatcg

SEQ ID NO: 58471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgtgtggttctgcctcgtattaactcccg

SEQ ID NO: 58472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgttatatgccatttgtctgcgaaagggt

SEQ ID NO: 58473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgttcctgccacagttacaaacttctaag

SEQ ID NO: 58474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgttcttttctttgcaaggctacaagcgg

SEQ ID NO: 58475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgtttcttgctgcacttgtggctctattg

SEQ ID NO: 58476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgtttggtgcagcctcataggagatgctt

SEQ ID NO: 58477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacgtttgttcatgcgccgctgccgtgtgcg

SEQ ID NO: 58478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactaacacgccttaggtgtcatggaacagc

SEQ ID NO: 58479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactacgaattgaagagtgcaagtacagaac

SEQ ID NO: 58480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactactgtagtttgttatggtaaatcgcat

SEQ ID NO: 58481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactacttttgctgacaccttgaccctgtgc

SEQ ID NO: 58482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactagcttcatgtcttctaagggtaacgtt

SEQ ID NO: 58483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactagggcagctacaccatggatttgtcca

SEQ ID NO: 58484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactagttgctcatgattcgttatgagtgat

SEQ ID NO: 58485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactataaggatcatcttgtgactcgctttt

SEQ ID NO: 58486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactcaacgatgagcgttatgtttgtagcta

SEQ ID NO: 58487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactcactgcgcctgttagaagagttaagtg

SEQ ID NO: 58488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactcagggttgtgattaagcgcatagggca

SEQ ID NO: 58489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactcatctctgataggtagaacggtctgtg

SEQ ID NO: 58490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactccagaggggatgcctgagatgccactt

SEQ ID NO: 58491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactccgggggaggtggaaccctctagatgg

SEQ ID NO: 58492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactcgaggaggtggaaatgattctcttatt

SEQ ID NO: 58493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactcgatgttcttacggttgttgaagctac

SEQ ID NO: 58494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactcggtcgagttggccggtccgtggctgg

SEQ ID NO: 58495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactcgtctaaaatagttatattgttcacgc

SEQ ID NO: 58496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactcgtggacggctcatttaagaccctgtt

SEQ ID NO: 58497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactcgtgtactcgttgtggctggttcgggt

SEQ ID NO: 58498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactcgtttgcggcggcgcgcgatcctctcg

SEQ ID NO: 58499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactctgtctttctattctgatcccctattg

SEQ ID NO: 58500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactgaccttgtcgtaatctatacgttctcg

SEQ ID NO: 58501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactgatagctcccccctactaccgagcgtc

SEQ ID NO: 58502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactgatgctgggaggaatgcgctaggtccg

SEQ ID NO: 58503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactgcaacaattcaactatataccagcagg

SEQ ID NO: 58504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactgcccaccccgtcctgcttactcacgga

SEQ ID NO: 58505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactgcctgtggcgatgatgatccacgtttc

SEQ ID NO: 58506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactgcggcggggtttgggtgtttatcacat

SEQ ID NO: 58507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactgcgggcctgtaagtagtgtaccaatct

SEQ ID NO: 58508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactggcatccggctttcaatcgcgcttttt

SEQ ID NO: 58509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactggcggatctgggccatcgcaggctaac

SEQ ID NO: 58510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactggggaaggctctggtcggtccttagct

SEQ ID NO: 58511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactgggtactgctgtgggcagctcggtacg

SEQ ID NO: 58512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactggtaacccggagcctggcccgattgag

SEQ ID NO: 58513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactggtccctcatgactaaataattgtagc

SEQ ID NO: 58514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactgtacggaccatatgtaggctgcgcata

SEQ ID NO: 58515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactgttaccggacactagtggagaaactac

SEQ ID NO: 58516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacttacattatctccgcttctatatcgtgt

SEQ ID NO: 58517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacttcaccagaggttgcggtttaccggaga

SEQ ID NO: 58518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacttccgaacgcgcggctgaagacgtattt

SEQ ID NO: 58519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacttctgtatcggacctctttctagtgacg

SEQ ID NO: 58520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacttgacattgaatggtgacgcaccgatcc

SEQ ID NO: 58521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacttgctagtacacatcctttcttccagtg

SEQ ID NO: 58522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacttggtccatccttcgggcactccgcgat

SEQ ID NO: 58523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacttggtcgctaagccgacatttgtattag

SEQ ID NO: 58524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taacttgtgtacgtcctcgggttctcaatagt

SEQ ID NO: 58525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactttaggccgaccactttctcggggcttg

SEQ ID NO: 58526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taactttattggatttctagattctgggcgga

SEQ ID NO: 58527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagaagttgctagggcacgggcactccgtga

SEQ ID NO: 58528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagaatcttctttaggtcttcggtaacagcc

SEQ ID NO: 58529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagaatgagctgcactaatgattcgttttgg

SEQ ID NO: 58530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagacaattgatgccgttatgttcccatgcg

SEQ ID NO: 58531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagaccgggattcataatgttttctccttac

SEQ ID NO: 58532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagacgcagatgaactagcgtgcactatacg

SEQ ID NO: 58533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagactgcaagacagattgtagggctcaaac

SEQ ID NO: 58534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagactgcgactaatgatctaagctcagtgg

SEQ ID NO: 58535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagacttgtactaataactgtcgagccctag

SEQ ID NO: 58536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagagcctaagtccgggcgttgcatgttaat

SEQ ID NO: 58537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagagcggaggtttgacttttatcttgctgc

SEQ ID NO: 58538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagaggccataaatcgttcctttttaaccga

SEQ ID NO: 58539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagagggttaaacatccagggaggatcgtgc

SEQ ID NO: 58540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagagtgctttggggagttgttggcccgatg

SEQ ID NO: 58541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagagtggggggtggtggtcccagtagtcac

SEQ ID NO: 58542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagatacgcgaaatgtttttaccctgcgccc

SEQ ID NO: 58543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagatagcatactgcatggacatttatattc

SEQ ID NO: 58544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagatccccgggagcatgggctttatcattg

SEQ ID NO: 58545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagatgactcttataatcgacggcccgagcg

SEQ ID NO: 58546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagatgccgaaaggaagtgtggactagcttt

SEQ ID NO: 58547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagatgctcgcacggcagtgattcaaagggg

SEQ ID NO: 58548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagattcattaaaccaaggctcgattggctt

SEQ ID NO: 58549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagattggatgcaatggaaacaaaagttaac

SEQ ID NO: 58550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagatttcaagcccactacaaacgcttagga

SEQ ID NO: 58551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcaaaaactgtctgctagatatgcacatc

SEQ ID NO: 58552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcaaaaggtgacaggatagcggcacggtc

SEQ ID NO: 58553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcaacgaagactacgcgcagaggtagatt

SEQ ID NO: 58554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcaagcaattgtctccttaacacagcggg

SEQ ID NO: 58555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcacagaggtggaccgcacaagcgcatcg

SEQ ID NO: 58556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcagaggtgtgggcgggaccagcggggag

SEQ ID NO: 58557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcagcgtagttcggatatgtgacgggtcg

SEQ ID NO: 58558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcagcttcgcctgtgcaattatcctcaac

SEQ ID NO: 58559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcaggcatgtatttcaaatcaaatgggag

SEQ ID NO: 58560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcagggggcggttccttctattggctcgt

SEQ ID NO: 58561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcatttttgaccacgactttttgcttgct

SEQ ID NO: 58562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagccacgggtctctccgcgggtgcaaggct

SEQ ID NO: 58563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagccacgtgcctacgcgtgtgagtagtagt

SEQ ID NO: 58564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcccgaagagcggaaagacatctgatcgg

SEQ ID NO: 58565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcccttctttcatggtaaaccatagttct

SEQ ID NO: 58566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagccgagcgagggattacacgtctgaaggg

SEQ ID NO: 58567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagccgccgggtttgcacctgagagatatga

SEQ ID NO: 58568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagccgctcttattcgacaattagtttaacc

SEQ ID NO: 58569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagccgcttcacttggtatcgcaggactggc

SEQ ID NO: 58570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagccggacagttcactgatctacgccttgg

SEQ ID NO: 58571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagccggagccacgcgctgtttcggctcgtg

SEQ ID NO: 58572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagccgtagcacacatgtggactgagcgttt

SEQ ID NO: 58573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagccgtgggtgggaaagggctgtggcggcg

SEQ ID NO: 58574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagccgttgtacagcagtcagagggaaatag

SEQ ID NO: 58575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcctaagtgtgccgcgacgatttgttagc

SEQ ID NO: 58576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcctattgggcccacccaaacacctagtc

SEQ ID NO: 58577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcctttaacgttactgctcccgtctcctg

SEQ ID NO: 58578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcgacgatctatgttgtcgtatctgcaaa

SEQ ID NO: 58579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcgatattattatctcctgacaaaactcg

SEQ ID NO: 58580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcgatgtttatcctctgctcgtctccgtg

SEQ ID NO: 58581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcgccgatggtgtttgattaaccgtccct

SEQ ID NO: 58582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcgcgatcatggggtatagatcgacggta

SEQ ID NO: 58583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcggatcggatctcgtatactagcagtgc

SEQ ID NO: 58584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcggccaggtatgaacttcggaagtatcg

SEQ ID NO: 58585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcgggagctccatgggcattcctttatcg

SEQ ID NO: 58586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcgggaggcgaaagattcggctgacgcgc

SEQ ID NO: 58587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcggggatctaacgttttctccggctgat

SEQ ID NO: 58588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcggggtcagtccctgttagacttaacat

SEQ ID NO: 58589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcggttcgtacgtcgggtgcgtgatttag

SEQ ID NO: 58590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcgtctatccgtggcctggactccctcat

SEQ ID NO: 58591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcgtgagggcgggaaccaaggagccgtgc

SEQ ID NO: 58592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcgttacccatcggctctcatgttcgtgt

SEQ ID NO: 58593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagctacaaggtatcaagactgcaatctagg

SEQ ID NO: 58594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagctacccagtcttaggctcgaatttgggt

SEQ ID NO: 58595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagctaggtcgaaattttccacgcccataac

SEQ ID NO: 58596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagctcaatgtcagcattctattgatcatca

SEQ ID NO: 58597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagctccgtcgcgcccggtttcggatatgcc

SEQ ID NO: 58598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagctgccattctcttcgttcgcgggtgcgc

SEQ ID NO: 58599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagctggcgcccctaagacgaatcaaccggc

SEQ ID NO: 58600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagctgggaggtaatgctgagcggtagctgg

SEQ ID NO: 58601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagcttttgtgtgcttgagcctctctgatac

SEQ ID NO: 58602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggaacggcttgctcgttgatacagtggca

SEQ ID NO: 58603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggacgaaacgtgctcagacgtggagtagg

SEQ ID NO: 58604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggacttaatgcggcggtgctaaggctagc

SEQ ID NO: 58605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggagacgcgacggtaaatatgacacaact

SEQ ID NO: 58606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggagcccagacacgttccgccccacgtct

SEQ ID NO: 58607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggagggctgaacggactggtggctgcggg

SEQ ID NO: 58608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggaggtctgaacatcacgggcccacgcga

SEQ ID NO: 58609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggatactgcaaccactggtttccgccctg

SEQ ID NO: 58610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggatgacactcgtcattggttctttacat

SEQ ID NO: 58611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggattctgcccagcttcgatggactgcct

SEQ ID NO: 58612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggcacgaaccgatgcgggggtttacggac

SEQ ID NO: 58613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggcagcgctaatggagtaagataatcgtg

SEQ ID NO: 58614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggcatcggtcgtgcgtatgtctttgtgga

SEQ ID NO: 58615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggccctgtatccgcgcggcgatcttccac

SEQ ID NO: 58616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggccgcctttacgcacgacgttagtttta

SEQ ID NO: 58617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggccggtattactacggatcgcctgctta

SEQ ID NO: 58618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggcgataggtttagattggcgtacccccg

SEQ ID NO: 58619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggcgcactgtgcagtgtaggaccggctta

SEQ ID NO: 58620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggctacgtatgggttgggtttgtgtaggc

SEQ ID NO: 58621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggctgcatttgattctcttcgcgtttgtg

SEQ ID NO: 58622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggctggccttcgttaacgtccagtacggt

SEQ ID NO: 58623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggaaactggagcccccaatgctttagga

SEQ ID NO: 58624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggagactcatttcactttgggtctctgc

SEQ ID NO: 58625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggaggtataagtttgggtacatggggtg

SEQ ID NO: 58626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggatatcgtaatgatgttcgtacgcgat

SEQ ID NO: 58627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggatggtgaggacccctaatgtcttatt

SEQ ID NO: 58628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggcaaaacaccctggtgcaagaggctcg

SEQ ID NO: 58629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggcagcatcggcctggtcttaaaagggt

SEQ ID NO: 58630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggcagcttattcgtgttacacctgcgcg

SEQ ID NO: 58631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggcatcgtacccgggttaacttaggggt

SEQ ID NO: 58632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggccgttgaaagtgctgttcttcactcg

SEQ ID NO: 58633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggcgttctctgctcaaggttttacgcta

SEQ ID NO: 58634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggctgccttctatcttatatattatatg

SEQ ID NO: 58635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggcttggatttcgccgacacgggcagtc

SEQ ID NO: 58636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggggagtggctccagggatctaatttgtg

SEQ ID NO: 58637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggggataacaaagcgttgcccattgcaca

SEQ ID NO: 58638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggggatgcgcgtaggcggtagttaggtga

SEQ ID NO: 58639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggggattggtggctgacagcgtagctccc

SEQ ID NO: 58640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggggcaggcccgaatggatcggtgcgcac

SEQ ID NO: 58641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggggcctttatagggttttacgcggggcg

SEQ ID NO: 58642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggggaaagggaccgacatgttgtaattg

SEQ ID NO: 58643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggggggattcgtcccagcacgcgattct

SEQ ID NO: 58644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggggtggggcatgtgcgagatatgcggc

SEQ ID NO: 58645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggggtgcctcgaattggatagtggctgac

SEQ ID NO: 58646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggggtgctaacggtccgagggggtgaatg

SEQ ID NO: 58647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggtaagccgggtctttttccctttgcgc

SEQ ID NO: 58648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggtacccaacgcaaacaacttagacaag

SEQ ID NO: 58649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggtattgttccagtctccgcgcgctaca

SEQ ID NO: 58650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggtcataatgggggtggggctgttacgg

SEQ ID NO: 58651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagggtgcgcgcgagctcgaaagacgcgata

SEQ ID NO: 58652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggtaagttcatcgcttggccaaacgcagg

SEQ ID NO: 58653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggtacgataagcctatacctcgtgcaccg

SEQ ID NO: 58654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggtattactgcgagtattttgttaagatt

SEQ ID NO: 58655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggtcctacgcatgctccccagataagttc

SEQ ID NO: 58656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggtctgggaacgagttggggtttgcgtgt

SEQ ID NO: 58657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggtgatcagattatccgcacctctgcaaa

SEQ ID NO: 58658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggtgattgtgattgagccgttgccttgta

SEQ ID NO: 58659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggtgccgctcggggtcgctgtactttgac

SEQ ID NO: 58660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taaggtgggccaggcggatgcccataacctga

SEQ ID NO: 58661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtacagctgaaggccatagaatgcacgga

SEQ ID NO: 58662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtacgtgagtgtctagctttcctcgagac

SEQ ID NO: 58663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtactgtatcccccttagcaggtaccacg

SEQ ID NO: 58664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtagatactaccccgacatacgcccgttc

SEQ ID NO: 58665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtatccaggatcagaacggaaggcacagc

SEQ ID NO: 58666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtatgaccccaacggcgatcgtgtggcta

SEQ ID NO: 58667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtcaacactggatccgtctgtctggcata

SEQ ID NO: 58668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtcaaggatcgtccagccgccctttgctg

SEQ ID NO: 58669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtcagggcgggtgcgtcggccactatacg

SEQ ID NO: 58670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtcatttcactctggtccctcggctactt

SEQ ID NO: 58671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtccgagcctttaagcaacgcatatacaa

SEQ ID NO: 58672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtctaggtacagtagtcgttgacgcatag

SEQ ID NO: 58673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtctgaagggaggtgcgagtacgttcata

SEQ ID NO: 58674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtgaagctcgatcgccacgctgggtccat

SEQ ID NO: 58675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtgatcccaatgtggcttttcttaaatgg

SEQ ID NO: 58676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtgcacgcagagaagttcagcttttgacg

SEQ ID NO: 58677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtgccacaatgagaacttaggtccctaca

SEQ ID NO: 58678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtgcgattcttgctcaaaaccgtttccat

SEQ ID NO: 58679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtggcacggtttggtgactggcgatcagt

SEQ ID NO: 58680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtgtcacgcacctcatggctcgaactgtt

SEQ ID NO: 58681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtgtgaagccgacatcctttgcctcctgc

SEQ ID NO: 58682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtgtggaacactggttcttgtagcgtgcg

SEQ ID NO: 58683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtgtttgaggggtttgcggtctcgggatt

SEQ ID NO: 58684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagttcaacagtactagtcacgggggtacgg

SEQ ID NO: 58685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagttgccggaacacgcagcacctagtggcg

SEQ ID NO: 58686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagttgtgggcggggccagcggctggtaaaa

SEQ ID NO: 58687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagttgtgttggacgctccgtgtggtgactt

SEQ ID NO: 58688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtttcattatcggtagtacgtcctgctac

SEQ ID NO: 58689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagtttcgattccgtatgtaatgtgtccctc

SEQ ID NO: 58690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taagttttcgtttaagtggtgtttaaagaagt

SEQ ID NO: 58691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taataaaggcctcatcttcgcgtgtgaattgt

SEQ ID NO: 58692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taataaatgggattgttattatttacgcttta

SEQ ID NO: 58693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taataacaaatttactatgtcgaaggcttacg

SEQ ID NO: 58694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taataacaagcttgggatctgggcgtttcttc

SEQ ID NO: 58695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taataacgagtagagacgagcaacattcagtc

SEQ ID NO: 58696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taataagactcaactcatcaaacccgcggttc

SEQ ID NO: 58697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taataagcgcgatgctgtgatcacggccctcg

SEQ ID NO: 58698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taataagggattgcagtgaacggtccctcgcg

SEQ ID NO: 58699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatacaagttatagtaagtgctgcactcata

SEQ ID NO: 58700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatacgctatgaggttaacttctacggaacc

SEQ ID NO: 58701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatactcggaccctgcgtcatgaactcggag

SEQ ID NO: 58702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatactgtaacatccagcttggggagagacg

SEQ ID NO: 58703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatacttagtgttttctaaatttacagaggt

SEQ ID NO: 58704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatagaatattatttcctgcttgtgccgatg

SEQ ID NO: 58705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taataggacctataatggcctgtccaaatgtt

SEQ ID NO: 58706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taataggggctctgcacacagttcgctagacg

SEQ ID NO: 58707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taataggtcaagggaacgtccgctactggact

SEQ ID NO: 58708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatataacctgtacgaccgggctgctctgga

SEQ ID NO: 58709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatatcatggaccggggtgcgggttggccgt

SEQ ID NO: 58710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatatcctcgatagcaaccgcgaatcgttgt

SEQ ID NO: 58711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatatcgattctcgtgactacgtggggagag

SEQ ID NO: 58712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatatcgccgttgccggtcaccacacccttg

SEQ ID NO: 58713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatatcttcggattcgcctctcaatatgtcg

SEQ ID NO: 58714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatatggacagtatacgacctgtaacgcaac

SEQ ID NO: 58715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatatggccggacgtcaagtggagtttgtta

SEQ ID NO: 58716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatatgttcccgcgtacttgctgcaataatt

SEQ ID NO: 58717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatattaccacgcctcccctcattacgctat

SEQ ID NO: 58718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatattgatgcaattgacggtgaattgcccg

SEQ ID NO: 58719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcaacggcattggaacagctgcgtttagc

SEQ ID NO: 58720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcacaataacggctggagacctcccatct

SEQ ID NO: 58721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcacgttcctcgaagacatgaggaatgct

SEQ ID NO: 58722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcacttcgccataactcgggccggagatt

SEQ ID NO: 58723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcagaggctgacctggggtgacggttctg

SEQ ID NO: 58724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcagcgtgtacgtatgcagtgcaggaccc

SEQ ID NO: 58725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcagttatgtttagccggtagagtttacg

SEQ ID NO: 58726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcatcgataatacgggcagtccgatcctc

SEQ ID NO: 58727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcatgattatcccatattaaggtaagtgg

SEQ ID NO: 58728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcatgcatcacattggtaggtcctttcgg

SEQ ID NO: 58729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcatttgtgccgggctggacccctgtgat

SEQ ID NO: 58730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatccagaggctgggtgggtcgtagcggttc

SEQ ID NO: 58731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatccagcgttggtcctccggtctacttttg

SEQ ID NO: 58732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatccatattaaatgttgaattaataccgtt

SEQ ID NO: 58733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcccgaaactcactgcgctgtagtagccc

SEQ ID NO: 58734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcccgatcgccatctggtgttgttcagtt

SEQ ID NO: 58735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcctgcttttcgttttttgtagactggat

SEQ ID NO: 58736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcgaacgggcgaccgatccgctcggtgtc

SEQ ID NO: 58737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcgaacggtggctcgttctgcattctcac

SEQ ID NO: 58738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcgaatctgcttatgtgtccgggtttatt

SEQ ID NO: 58739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcgaatgcgcactgtttcggccaaattgt

SEQ ID NO: 58740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcgcctaatttgtgcggtcgtacatgtgc

SEQ ID NO: 58741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcgcgccctggctagcctgaggatcttgg

SEQ ID NO: 58742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcgcgtcgcatcgccgcatgcgaatctct

SEQ ID NO: 58743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcgcttctgtggttggtggtggggcaagg

SEQ ID NO: 58744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcggaagagtctgtctcctttgtcgtcat

SEQ ID NO: 58745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcggaccaagtcgtcctggctcgacagct

SEQ ID NO: 58746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcggagccgcgggttttaacgtcggtctg

SEQ ID NO: 58747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcggcgaactcgacatgtattagctttgt

SEQ ID NO: 58748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcggtatcatgcttcgtggcggtttttaa

SEQ ID NO: 58749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcgtctcgttgtttttgagggtcaattta

SEQ ID NO: 58750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcgtgcctgctcacaacctgtttataaga

SEQ ID NO: 58751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatctacgcgtgcaatgtgcggtgccgttta

SEQ ID NO: 58752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatctccccgctgctcgcttatggccaccgg

SEQ ID NO: 58753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatctcgcgcaagggtacgagggcatgccgg

SEQ ID NO: 58754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatctctggctgaccgtgatttgtcagttgc

SEQ ID NO: 58755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatctgagttttgtgattcggtacgcggaaa

SEQ ID NO: 58756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatctggacaccatctcattagtgtagcacg

SEQ ID NO: 58757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcttaaaacgcagagagcggcctataact

SEQ ID NO: 58758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatcttgcattcctggatatgagggcaacga

SEQ ID NO: 58759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgaatcaggtcggctctaattttttctat

SEQ ID NO: 58760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgaccagttggggattatttcggaatgat

SEQ ID NO: 58761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgaccccctgccagcggggacaagcagtt

SEQ ID NO: 58762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgacgcacagctatctatgtgctataatc

SEQ ID NO: 58763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgacggttttcttcagaccccaggcctcc

SEQ ID NO: 58764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgactcttcctccatactggcatcgatac

SEQ ID NO: 58765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgagattagtggagaccttttactactct

SEQ ID NO: 58766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgagtggcggtattgtcgttgcgtatgtg

SEQ ID NO: 58767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgatgacgatcggctgtaaatgatgaggt

SEQ ID NO: 58768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgattactggacttgtatacgtcctccgc

SEQ ID NO: 58769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgcccattcctattcttggacggatactc

SEQ ID NO: 58770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgccgaggaattacttgtcagttataggc

SEQ ID NO: 58771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgccttgtaatgccaatcatggttgcggc

SEQ ID NO: 58772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgcgagtcggccgatgcgtctactgtatg

SEQ ID NO: 58773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgcgccgcacagtggttgttggctgatgg

SEQ ID NO: 58774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgcggggttggcgtaagacacatcagtcg

SEQ ID NO: 58775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgcgtccggtcagtccacatcttcggtta

SEQ ID NO: 58776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgctatcagctctgggaattctggttaac

SEQ ID NO: 58777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgctgattggcggcccctacccccgcggt

SEQ ID NO: 58778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatggaagggggagaaggcattttcgggatt

SEQ ID NO: 58779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatggacgaatcgaatcgtgcgatggcatgt

SEQ ID NO: 58780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatggacggcgcaaagaatcatcggcgatcg

SEQ ID NO: 58781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatggcagctaagaaggactacagctctggg

SEQ ID NO: 58782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgggaagcacaccatccttcggccgctgc

SEQ ID NO: 58783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgggataggcatcaacacggtccatgtga

SEQ ID NO: 58784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgggggctttgtgaagtctgggagctcta

SEQ ID NO: 58785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatggggtataatgtatcccgcactactagg

SEQ ID NO: 58786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatggtctaacgcacagtgatggacaaccgc

SEQ ID NO: 58787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatggtggcagaatgacgggtagagagcggg

SEQ ID NO: 58788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgtaaatgattcgttaggtctgcgacacg

SEQ ID NO: 58789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgtcagctctcttctcagttatgcgtcac

SEQ ID NO: 58790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgtcctaggtttgcgaggttttccgtgtc

SEQ ID NO: 58791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgtcctggacctggctcatttcgtgtttc

SEQ ID NO: 58792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgtctggtaactataaagggcgatgttag

SEQ ID NO: 58793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgtggctggatatggttgaacctctgatc

SEQ ID NO: 58794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgtggggggtgaacgcaattttcacttgg

SEQ ID NO: 58795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgttggcggagcgtagtactcgccggcca

SEQ ID NO: 58796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgtttatcgtttcgcagtgtgcctctgca

SEQ ID NO: 58797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatgtttgtaatcggatagtaacttacaggc

SEQ ID NO: 58798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattacgggagtttaagtatgagctcaagtt

SEQ ID NO: 58799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattagggatccaagcttgttgtgcccgccc

SEQ ID NO: 58800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattagtaaggtttttttgaggtctgcatta

SEQ ID NO: 58801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattattgatccccgtatgcggtccatgact

SEQ ID NO: 58802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattccagtcttttgaggcttaacaggcggt

SEQ ID NO: 58803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattccggatggccacggagaagcggtcttt

SEQ ID NO: 58804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattcctaccacttgtcttgctaattttctg

SEQ ID NO: 58805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattcctttggttccgcggattagactttcg

SEQ ID NO: 58806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattcgtaagtggttgcaagcggaccaattc

SEQ ID NO: 58807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattcgttcatagttccgtaggaccgagagc

SEQ ID NO: 58808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattctaacttttccgcaggccgtattacct

SEQ ID NO: 58809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattctctttaagctgcaaggggtttagaac

SEQ ID NO: 58810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgaacggatatgagtggcatggcatcat

SEQ ID NO: 58811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgagctgccgatatgtacgcttcccttt

SEQ ID NO: 58812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgccagcgatgtttcaccttagcctgag

SEQ ID NO: 58813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgcgagaagacacttagtggaatattat

SEQ ID NO: 58814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgcgtgacttgttgccattgctcatcgc

SEQ ID NO: 58815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattggcgccgattggaaagcatctcggtga

SEQ ID NO: 58816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgggagttcacggaatagttgagatccg

SEQ ID NO: 58817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattggtcattccaggttcaccggccctacc

SEQ ID NO: 58818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgtatatctttgagtgctagggatcggt

SEQ ID NO: 58819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgtgcctcaggataggttgacacggtcg

SEQ ID NO: 58820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgtgtttaatatcgcctttacctgccct

SEQ ID NO: 58821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgttaatccggtgagcgctcgaaattgc

SEQ ID NO: 58822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgttacaagacgtccgccaatgttcgag

SEQ ID NO: 58823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgttcgcgatccgcgtcgtggacgtgtg

SEQ ID NO: 58824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taattgttttttctctctctgactactttagt

SEQ ID NO: 58825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatttccacatcgaaaaatgtatctcacgtc

SEQ ID NO: 58826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taatttccgctagctcccaggtactttttagg

SEQ ID NO: 58827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaaaccaatgacacccccataacccttta

SEQ ID NO: 58828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaaaccgagggacagtagcacctaatggg

SEQ ID NO: 58829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaaacgtcggaggttagacaattcttgct

SEQ ID NO: 58830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaacctgggagatacaggttcgtcagctc

SEQ ID NO: 58831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaacgagcctaccctctttcacgggtggg

SEQ ID NO: 58832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaacggggattggggcgaatcttctgttt

SEQ ID NO: 58833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaactcgtgatgcccgtaaggtggagttg

SEQ ID NO: 58834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaacttttcgcgacgacctgaccagtgga

SEQ ID NO: 58835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaagcgtgggtcatcagcgcacatctggc

SEQ ID NO: 58836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaatcggaattgcgggtgcggaaggtcgg

SEQ ID NO: 58837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaatggaaatactttgatcaaggatcagc

SEQ ID NO: 58838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaatggctactagcggtcggaacatgctt

SEQ ID NO: 58839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaacacccggacacggtaggcgcatttgtg

SEQ ID NO: 58840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaacactgttcggcccctgctgcgataaag

SEQ ID NO: 58841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaccaggctcgatgtttgattcccagatc

SEQ ID NO: 58842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaacctgataccaatacgtccaacggcatg

SEQ ID NO: 58843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaacctgcggcattcgtaggcgagtaagcc

SEQ ID NO: 58844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaacgcggaccatcatattaaactgctggg

SEQ ID NO: 58845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaacgctgaatgtacacccggagtctttcc

SEQ ID NO: 58846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaactcaattcagtcctcaagaatgggaag

SEQ ID NO: 58847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaactcacagcagcaactatctaagcggag

SEQ ID NO: 58848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaactccctaggactttccaccatctacca

SEQ ID NO: 58849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaactgcccggtctttgcgtgaggctctgg

SEQ ID NO: 58850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaactgcgcatccgctacaacgtcccgtct

SEQ ID NO: 58851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaagaaagaaaccacctttttggttttctc

SEQ ID NO: 58852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaagaccaattgaagttcgcgccgagacgg

SEQ ID NO: 58853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaagcaccgatcctagctcttaataggcat

SEQ ID NO: 58854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaagccccaaggtgtgatctccggggaacg

SEQ ID NO: 58855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaagcggtttcggacgagcacccaaacgtc

SEQ ID NO: 58856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaggctacgtttggtccttccagtgacgc

SEQ ID NO: 58857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaggtatgttccacaaagctggcgtcggt

SEQ ID NO: 58858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaaggtcacttcggagaactgcatggccgt

SEQ ID NO: 58859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaagtgagagccggcaaaactggggcgggc

SEQ ID NO: 58860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaagtggccgcgcacctacgtgttccagtg

SEQ ID NO: 58861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaataccagcggtggtctgccatttcgttg

SEQ ID NO: 58862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaataggcggtgactgtctgtacgtgtccg

SEQ ID NO: 58863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaatatgcactcgtgataaggggaaacgat

SEQ ID NO: 58864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaatcacttaagggaagagacggctgctgc

SEQ ID NO: 58865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaatcttcgaccatccactctagcttgttg

SEQ ID NO: 58866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaatgcgacttcttgacaccgggaagcatc

SEQ ID NO: 58867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaatgcgggttaaaagtatctttttcctcc

SEQ ID NO: 58868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaatgttgctttgtgcttacatcctcaccc

SEQ ID NO: 58869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaattgcccggatggtggaagataccttgt

SEQ ID NO: 58870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacaacggccgaccgacatctgcgtgattt

SEQ ID NO: 58871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacacacgcggatgtaactagccaaaggtc

SEQ ID NO: 58872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacaccgtgacatgtgtggtgtttttcctg

SEQ ID NO: 58873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacacgcctccacagctcaactgccggtcg

SEQ ID NO: 58874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacacgggctaggcagatctagaatgtggg

SEQ ID NO: 58875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacacggtcagcgaagtggtacgtcaaatg

SEQ ID NO: 58876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacacttcggtttacctactcatgcgcttc

SEQ ID NO: 58877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacagcagaggattgatgcgtcggagcgga

SEQ ID NO: 58878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacagcagcggagggcactatgaggtcaag

SEQ ID NO: 58879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacagccatcgcggggatgccgttggtgtg

SEQ ID NO: 58880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacagccgtcctgagggagtgctgggctcg

SEQ ID NO: 58881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacagcgagtcccatttactcgcttagacg

SEQ ID NO: 58882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacagcgatcaggcttgtatccgctggtcc

SEQ ID NO: 58883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacagcggtgtttgtgtttactgatatcga

SEQ ID NO: 58884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacaggaattagggaccggacggtgtgttt

SEQ ID NO: 58885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacaggccagcttgagcgttgatttatgcc

SEQ ID NO: 58886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacaggtaggcttctggtataaactgacat

SEQ ID NO: 58887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacatcatcattggtgaagcatatcatgct

SEQ ID NO: 58888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacatcatcctagcgcgggtgagatgggga

SEQ ID NO: 58889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacatgttagggaacccgggatctctaggg

SEQ ID NO: 58890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacccagtcttcaaatccgaacccagatag

SEQ ID NO: 58891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacccgggcgagaatactctgccggagatc

SEQ ID NO: 58892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacccgtggaatgattcccccattaaggcg

SEQ ID NO: 58893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacccgtttcttaagtctaaagcgttttct

SEQ ID NO: 58894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaccctcagcgggcgcatcggggggcctgg

SEQ ID NO: 58895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaccgaattcatgataacagccaacaacgc

SEQ ID NO: 58896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaccgactacgtagagggcggtactttcgg

SEQ ID NO: 58897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaccgcttttcgcttgagggtagccgagat

SEQ ID NO: 58898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaccgtggaacgactatgacgtgatctggg

SEQ ID NO: 58899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacctatcgcgtggctagttccgttttagg

SEQ ID NO: 58900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacctccataccacacgcatactacttcca

SEQ ID NO: 58901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacctgatgaccaaccgtgttcggctcgct

SEQ ID NO: 58902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacctggcgttataagatccttctgtcatt

SEQ ID NO: 58903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacctttttaagtttgtggtgtggaagtac

SEQ ID NO: 58904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgacttccgcagattgggcgcgcacggg

SEQ ID NO: 58905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgagggaacatacgatcgagccaagtca

SEQ ID NO: 58906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgatatctaattttgtagagtacctcgc

SEQ ID NO: 58907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgatatctctctcatgggtgctaggtgc

SEQ ID NO: 58908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgattcattgacgatggtggtccagatt

SEQ ID NO: 58909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgcgcatggttcgttctagactggacgc

SEQ ID NO: 58910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgcgcccgtagacacatcggtgaaagca

SEQ ID NO: 58911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgcgtggaaatggccagctgcgctgggg

SEQ ID NO: 58912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacggccgcgaagttagtgcatacgaccaa

SEQ ID NO: 58913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacggcggtttacctggtcggttactcccg

SEQ ID NO: 58914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacggtagcgccccagcatcttagcgtcct

SEQ ID NO: 58915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgtcaggcagacttacacttcccttagt

SEQ ID NO: 58916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgtcatcgtacattgccatatctgcaac

SEQ ID NO: 58917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgtcattgtatgaggagcggtcgctatt

SEQ ID NO: 58918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgtctctcgcgtctgtgcgaacggccaa

SEQ ID NO: 58919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacgtggttgcaaaaacgcttgttctcatc

SEQ ID NO: 58920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacactcaagttgatactaggatctacacaat

SEQ ID NO: 58921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacactcaccatgcgtcagggatcggagcttc

SEQ ID NO: 58922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacactcagcgattcttattcactcgaccccg

SEQ ID NO: 58923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacactcctagcgtctcccttttggcctttgc

SEQ ID NO: 58924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacactctcgtttctcttgttacagctccccg

SEQ ID NO: 58925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacactcttttgacttcttattagcgtagcaa

SEQ ID NO: 58926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacactgatagctgttagtcctcctccagagg

SEQ ID NO: 58927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacactgcaacatagtcaatgtacgctgctgg

SEQ ID NO: 58928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacactggcgtcgtgtctcagattattgcatt

SEQ ID NO: 58929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacacttgtgcgttgggtttggctcctaagcc

SEQ ID NO: 58930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagaatattctgtggccgtatgtcaattgt

SEQ ID NO: 58931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagaccagatgcatgttgctcggctataac

SEQ ID NO: 58932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagacctgcagagatgcctcacgacgctgg

SEQ ID NO: 58933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagactctgaaatcatgggcccgtccgcca

SEQ ID NO: 58934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagagcgatgaagatggctttctgtgtgag

SEQ ID NO: 58935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagatcacctcccggcattttctcgacacg

SEQ ID NO: 58936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagatcgagattcttgtgattggatccact

SEQ ID NO: 58937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcaactattgtaactgcagcgggtagac

SEQ ID NO: 58938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcaaggaccggcgccttcgcgaatagtg

SEQ ID NO: 58939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcaagtggcgtcttcgggttagcctcgc

SEQ ID NO: 58940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcacacccaagcttggcggcacttttcc

SEQ ID NO: 58941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcactctcggtcttgccgctagccaagt

SEQ ID NO: 58942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcaggcttggtcgggtctactcttagcg

SEQ ID NO: 58943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcagtaccagagatatgtttcagaggaa

SEQ ID NO: 58944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcataggtgtggaaagggctaaggaacg

SEQ ID NO: 58945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcatatgaggaaatatctttgaggcgac

SEQ ID NO: 58946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagccacataccgacttagcgcccggtcgt

SEQ ID NO: 58947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcccccagacataaggcacatgcctagc

SEQ ID NO: 58948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagccctttaatttctattcgcttagaaca

SEQ ID NO: 58949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagccgagcacggtggaagttcagcatcgg

SEQ ID NO: 58950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagccttgtcctggaagccagtaaatgcgc

SEQ ID NO: 58951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcgagctgggtgcataacctcgtgcttc

SEQ ID NO: 58952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcgcgcccggttcatccgtcacgtccat

SEQ ID NO: 58953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcgctcggtgtggtctctggtatgacat

SEQ ID NO: 58954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcggataagtgaggtggttgcggcgatg

SEQ ID NO: 58955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagcggggttagggcatacttgtttagagg

SEQ ID NO: 58956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagctaaggcgaggattggccttgatatcg

SEQ ID NO: 58957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagctaggctgttagttggggttgtacgct

SEQ ID NO: 58958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagctagtgcgaccatcaaaggttaggcgg

SEQ ID NO: 58959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagctatctcatatttgctctcctctcgtg

SEQ ID NO: 58960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagctgagccaggggcaggaccatggtgcg

SEQ ID NO: 58961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagctgcgtgatcaccaccggtttattcgt

SEQ ID NO: 58962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggacaccgtgtttttgagggttttgtgt

SEQ ID NO: 58963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggacgcgttcacactgtagctttcgcga

SEQ ID NO: 58964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggaggtggtctgcaatttggatccgctc

SEQ ID NO: 58965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggatactggtggggagcacgcgggcctc

SEQ ID NO: 58966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggatggcgtgtcccatacgatcttgtat

SEQ ID NO: 58967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggattttgaggggacgctgagccggggg

SEQ ID NO: 58968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggcaggctttaaaacaacccgagttgtt

SEQ ID NO: 58969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggcagtccaagggtgagcgccacgcact

SEQ ID NO: 58970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggccaggggacgttggccttcggttttc

SEQ ID NO: 58971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggccatgtcgtcaaccggttctctacat

SEQ ID NO: 58972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggcccgttccagagaaacgcaagcacgc

SEQ ID NO: 58973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggcgctgcgctgttgttgtgctggggca

SEQ ID NO: 58974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggcggaacgagcggctacgactcgggga

SEQ ID NO: 58975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagggatcgctcgctaaaacttctattgct

SEQ ID NO: 58976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagggcagccgcacaatgtggcggtggtgg

SEQ ID NO: 58977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagggcctaatggtgggttagtcctcgcct

SEQ ID NO: 58978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagggtcagcatgaaggtgttcgagaatct

SEQ ID NO: 58979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagggtgagaggtcggtccgatcaatgtta

SEQ ID NO: 58980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacaggttgcctggcatatagcgccgctgcgt

SEQ ID NO: 58981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtaaacatgcaagaggtatcaatgttcg

SEQ ID NO: 58982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtactatggcgcttaaagctgcgtagtc

SEQ ID NO: 58983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtagggcagttgggcaagttatcggttg

SEQ ID NO: 58984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtaggggatgagcgttagacagctgagg

SEQ ID NO: 58985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtagttcttgcattattcactggcacac

SEQ ID NO: 58986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtcaagactcctgcctcgcgcgttcacc

SEQ ID NO: 58987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtcagagcaaagatcagccaggggtgcc

SEQ ID NO: 58988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtcatgtagtgccaaagggtacttgtac

SEQ ID NO: 58989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtcctcccgtgggtcacgaccccttgct

SEQ ID NO: 58990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtctcgaaagggtcctttgcaccggcat

SEQ ID NO: 58991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtgcaccgttcgatgcggccgagcaata

SEQ ID NO: 58992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtggatttctggacgttgcaggttctaa

SEQ ID NO: 58993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtgtagtcagtgttggctgataggtatt

SEQ ID NO: 58994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagtgttgcatatctggaagcatagaattg

SEQ ID NO: 58995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagttaatagccgtggaaatattaggagtt

SEQ ID NO: 58996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagttcaactgctgcgacacaatgttacca

SEQ ID NO: 58997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacagttgggaattctatggcacaacatttga

SEQ ID NO: 58998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacataaagcacccgattctgccttcaaccct

SEQ ID NO: 58999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacataatgagctccaggatgcccgaacctta

SEQ ID NO: 59000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacataatttctggcaccggggcggagagtga

SEQ ID NO: 59001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatacactttcgtggtctgtagtgcttccg

SEQ ID NO: 59002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatacatcctcgcgcatcgcccgaattgtg

SEQ ID NO: 59003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacataccttggattcatttataggtgctgcc

SEQ ID NO: 59004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatacgtctcggtatagctgcccctttttc

SEQ ID NO: 59005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatagcacatctgtccgttgcgcgtcacac

SEQ ID NO: 59006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatagccagggccttataatgcaatgccga

SEQ ID NO: 59007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatagctgaaggacggctagttcgctcgtt

SEQ ID NO: 59008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatatatctaatacgggcagttaagttagg

SEQ ID NO: 59009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatatgatctcgttacgcattcgctcttct

SEQ ID NO: 59010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatattagggtgacgaaaatatttgtatcg

SEQ ID NO: 59011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatcatggggagttgaggctagtgcagcga

SEQ ID NO: 59012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatccagaaggatgggtcaggttccttggg

SEQ ID NO: 59013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatccagggttacatttggcatggtaacat

SEQ ID NO: 59014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatccgactgcgaattggttgcttccatgt

SEQ ID NO: 59015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatcgcgtagtggtggggggaatgctcgag

SEQ ID NO: 59016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatcgctaaggaagcgggcgcgtggtgaga

SEQ ID NO: 59017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatcggcacgcggtttaacgtttagtccgc

SEQ ID NO: 59018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatcgtgccactggaattggttgctacact

SEQ ID NO: 59019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatcgtgcttgacagagacgactagctctg

SEQ ID NO: 59020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatctagtcttcggcggaagcgaaacacac

SEQ ID NO: 59021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatcttctctgcgtatttgccgttcttgcg

SEQ ID NO: 59022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatgcacatcaagtatccgtgcgtcctaca

SEQ ID NO: 59023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatgcccgacacagacagtctacagcaggt

SEQ ID NO: 59024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatgcctatgcagccctaggtttcgtacgc

SEQ ID NO: 59025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatgctcgacatcagaggtgtttggtgttt

SEQ ID NO: 59026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatggatagtgctaagcagtcataggaggc

SEQ ID NO: 59027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatggccttaggatcaagtgttgcatacgg

SEQ ID NO: 59028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatgggaaagttccctccgagtgatatgta

SEQ ID NO: 59029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatgggaacgtttggctgttaaccgtctcc

SEQ ID NO: 59030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatggggcgcaagtgagggaagggcagatt

SEQ ID NO: 59031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatgggtcgggaggcccagttgggtggtat

SEQ ID NO: 59032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatggttccttactatcgtctcgcgactgt

SEQ ID NO: 59033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatgtcacgagttggttgctcggtcgaacg

SEQ ID NO: 59034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatgtgaaggcagcatcaccgtcgattggg

SEQ ID NO: 59035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatgtgggaagaggaattctgtttgcgagg

SEQ ID NO: 59036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatgttgcggccggcaccttgtagtcgtta

SEQ ID NO: 59037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattaagaaggcctattagcaagcgtttat

SEQ ID NO: 59038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattcatgatcgcgttccgggagtaaggct

SEQ ID NO: 59039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattctcctaccgggaatcattaggtacta

SEQ ID NO: 59040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattctctcacttcgaagcacctgtgctcg

SEQ ID NO: 59041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattgaacctgattggcgaatacccatccg

SEQ ID NO: 59042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattgaagctcgtgtcatccagtctgcgct

SEQ ID NO: 59043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattgacacggggtgaggggttgtcgcggg

SEQ ID NO: 59044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattgaggacctgtgatacctacgcaatac

SEQ ID NO: 59045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattgcagctaacgtcccggggttcggtac

SEQ ID NO: 59046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattgcttgtacttacgcatataatcagtt

SEQ ID NO: 59047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattggtcacgttctagattcacctgtggg

SEQ ID NO: 59048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattgtggggttcgcggccgtagacacaac

SEQ ID NO: 59049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatttagtgtcgtcccttcgtattggtaat

SEQ ID NO: 59050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacatttggccaatgggaaatcttcgagatgg

SEQ ID NO: 59051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacattttttgtagcatatccgccgtataatg

SEQ ID NO: 59052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaaagtgctgctcgcggggttggactgca

SEQ ID NO: 59053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaaagtgggcctactgcatagggcggcga

SEQ ID NO: 59054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaaatcgcgaccggaaaccgatagccccg

SEQ ID NO: 59055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaacccatgaccgccacaggctccattgt

SEQ ID NO: 59056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaaccttaagatcggatggtttcaggcag

SEQ ID NO: 59057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaactattccagagaccccatgttccgcc

SEQ ID NO: 59058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaactgaacaggacgagcggtatcccgga

SEQ ID NO: 59059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaactgttcttggatgtgatgcatgtttt

SEQ ID NO: 59060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaacttgtaagctgtcaagataccgcgcg

SEQ ID NO: 59061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaagaattgcgccggtgctcctggagaga

SEQ ID NO: 59062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaagacggcgaccagtgcgtttattgtgc

SEQ ID NO: 59063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaaggctcactcaacaggggtagtttgtt

SEQ ID NO: 59064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaatcgttggcaactattgtggtagattc

SEQ ID NO: 59065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaattccttcaattccgagcgaactttcg

SEQ ID NO: 59066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccacaaccagtcccgtaagctaagcggtcg

SEQ ID NO: 59067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccacaattgtgctcgtcaatagacttgtcg

SEQ ID NO: 59068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccacacagcggaacgtggacgggtttgttt

SEQ ID NO: 59069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccacacggaaagatcgagagcgcgttcggt

SEQ ID NO: 59070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccacatcctgagcccatcgttgagtgataa

SEQ ID NO: 59071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccacattctcgtacgccagctgctaggtcg

SEQ ID NO: 59072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccacgattcaggagcacgggtctagctgat

SEQ ID NO: 59073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccacgtcgaattagacgagtttggaacggg

SEQ ID NO: 59074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccacgtgcaagacattattcgaatttaggt

SEQ ID NO: 59075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccactaacaatagagccaagtcctcttggg

SEQ ID NO: 59076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccactcgatgacacatgcgccatctcactg

SEQ ID NO: 59077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccactttcccattttcgaagttaagccgat

SEQ ID NO: 59078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccagaactcgatagagaacaggcctccttc

SEQ ID NO: 59079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccagagccgcacaatactggcacccgtgac

SEQ ID NO: 59080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccagcacgccgcgtccatggagaccttacc

SEQ ID NO: 59081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccagcattataccctcgtcagatctcgtcg

SEQ ID NO: 59082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccagcattgcttgtagtgtaatgagcggcg

SEQ ID NO: 59083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccagccgccaaaagacagctcttgtatcgg

SEQ ID NO: 59084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaggagttcactacaacacacggtcgaga

SEQ ID NO: 59085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaggcggcttgctgcagaccgaagccttc

SEQ ID NO: 59086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaggcgtaggtctggaattccggcagctc

SEQ ID NO: 59087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaggctgaccacacggcagtttggctgag

SEQ ID NO: 59088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccagggctgccttgtctagactgtatatcc

SEQ ID NO: 59089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaggggtgttggctgtgttgggccgtttg

SEQ ID NO: 59090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccaggtgcgcaacaagctcggtgtataccg

SEQ ID NO: 59091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccagtattgtgtcaccagtacagtgtttct

SEQ ID NO: 59092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccagttcacgtctgaggctgggatttcagc

SEQ ID NO: 59093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccagttcgcgcctcttaactgggagagcgt

SEQ ID NO: 59094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccataagcccttatagcttcgaatgctact

SEQ ID NO: 59095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccataattacacgacatagcggagacccat

SEQ ID NO: 59096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccatacgctgcgtacgacaactcgatcgga

SEQ ID NO: 59097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccatatgtggttaaaggggcaagcagtaat

SEQ ID NO: 59098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccatcattacgaaaacgctggcttactggc

SEQ ID NO: 59099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccatcgtaaactctcactggcagcccgggc

SEQ ID NO: 59100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccatcgtgtccagtcgctcccttcgggtat

SEQ ID NO: 59101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccatctcgcaattatttcgttcgttgatta

SEQ ID NO: 59102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccatgcgtgcagtgtccctttctccgtttt

SEQ ID NO: 59103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccatgggaaactgacctttttgcacgtggc

SEQ ID NO: 59104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccatggtccgtgcactcctgtagcggtgga

SEQ ID NO: 59105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccattcaataactcgtcccgatgccatgtt

SEQ ID NO: 59106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccattgcagttgaaactttctctcttgcgc

SEQ ID NO: 59107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccaaacaacttagcgcaatagtgcacctg

SEQ ID NO: 59108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccaacccatcccgacgaggctggtatcgt

SEQ ID NO: 59109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccaacgaaattactagggcccggcacgga

SEQ ID NO: 59110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccaagagatgcgcggaagtggttagcagg

SEQ ID NO: 59111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccaccgatgtcacccgaagaagagtgggg

SEQ ID NO: 59112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccaccggtagcgcagtgtgtcatacgggg

SEQ ID NO: 59113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccactaccccgccctctctgcgtagaatc

SEQ ID NO: 59114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccagattatcatatcacccgcgctggtac

SEQ ID NO: 59115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccataagcttattcgggtgcgctattgag

SEQ ID NO: 59116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccatcgaagcacagtcggttccgaaacga

SEQ ID NO: 59117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccccagctgcgcctggatcaccacatagtt

SEQ ID NO: 59118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccccaggcagtggtgatgctaaggagtcga

SEQ ID NO: 59119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccccaggccctgtattagcgcatgagctc

SEQ ID NO: 59120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccccgaacattagacgtcttccatttgctg

SEQ ID NO: 59121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccccgcataaagcaggtcccgtgttcacgt

SEQ ID NO: 59122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccctgacggccccgacctactgttttgtt

SEQ ID NO: 59123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgaatccacctgcgaatagtttaagcgc

SEQ ID NO: 59124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgaggaattgccgggacaagcgaatatc

SEQ ID NO: 59125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgatcgatggtgggtagcggagcggttg

SEQ ID NO: 59126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgatggtcgaggacgaaaatgagtgctg

SEQ ID NO: 59127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgcattcacaggttgggcaaagatatcg

SEQ ID NO: 59128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgccatctccttcacattctccatattg

SEQ ID NO: 59129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgccgcccgccgggctatactgttagtg

SEQ ID NO: 59130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgccggaccaaggctactttccccggat

SEQ ID NO: 59131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgcggcagccggaaaacttggccactca

SEQ ID NO: 59132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgcggtcgatacttgtttcgcgcgtttc

SEQ ID NO: 59133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgctgattacggcggactcgtatatctg

SEQ ID NO: 59134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgcttagctacatagggcaccccgcctc

SEQ ID NO: 59135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccggagggtgttagtggctactcatatag

SEQ ID NO: 59136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccggagtggactccgacacacgacatgcc

SEQ ID NO: 59137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccggataacgagtgtcaccgcgaatcagc

SEQ ID NO: 59138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccggcatcatgatatcgctagctgccgac

SEQ ID NO: 59139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccggccatactgtcaggttgcgggcattc

SEQ ID NO: 59140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccggcgaggagacctgtttttgtggcctt

SEQ ID NO: 59141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccggcgtatcgagtagagcatgacggaac

SEQ ID NO: 59142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccggggattgtagagcgctcccgttcacc

SEQ ID NO: 59143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccggtagtcaggggcaggccgatgaggca

SEQ ID NO: 59144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgtattaaactaggtgtcacgcgggagt

SEQ ID NO: 59145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccgtctggcgggcgcgggtgtttcgtggc

SEQ ID NO: 59146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccctaagggcgacgcgtccggttatcccac

SEQ ID NO: 59147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccctaatcggtgggtcctgttagtccgtca

SEQ ID NO: 59148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccctacgccaggactttttccgtgatagtc

SEQ ID NO: 59149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccctagacaccgcattcgcagcgattacgt

SEQ ID NO: 59150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccctcatccggcgcccgaacatagccatcc

SEQ ID NO: 59151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccctcccatacgtattcttacggcgactcg

SEQ ID NO: 59152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccctcgccagccctctttgattctgcggga

SEQ ID NO: 59153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccctgactgcacagacacttatacaaagca

SEQ ID NO: 59154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccctgtaagcgctccctcttgatcggtggc

SEQ ID NO: 59155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccttacaggaggtatcggttcgaacgact

SEQ ID NO: 59156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccttcaatatccaccgcactatccttcac

SEQ ID NO: 59157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccttcgcggcgaaaatgcttgagttggca

SEQ ID NO: 59158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccttgatgttacagctcttcctatccttc

SEQ ID NO: 59159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccttgcattcgcattctgtcgactgtata

SEQ ID NO: 59160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccttgtcgtggcattgcttggattgagcg

SEQ ID NO: 59161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacccttgtgccttttccgaggtgattgtcct

SEQ ID NO: 59162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgaactgaatcccgtgacgcctagcgctt

SEQ ID NO: 59163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgaccgaagggtgttgcgcgcgattcgac

SEQ ID NO: 59164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgaccggatgttctacaagttaatcttac

SEQ ID NO: 59165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgacgaaatgcgtggcgttcactgatacg

SEQ ID NO: 59166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgactcacgaagagggtccttgggtggag

SEQ ID NO: 59167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgagaaagaactgaggtcgggatagcccg

SEQ ID NO: 59168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgagaacggaaacagaaagtatggggtta

SEQ ID NO: 59169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgagaagttcgaagtttcgtcctttgtcg

SEQ ID NO: 59170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgagaatgtcctagctaagggtatatgtc

SEQ ID NO: 59171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgagcagctaactttgctccgcgccctcc

SEQ ID NO: 59172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgagcgagtgttcgtaacgctggttcatc

SEQ ID NO: 59173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgagcgccagatcgccacatagctggtcg

SEQ ID NO: 59174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgagctcctatagcgtatcttgctccgtt

SEQ ID NO: 59175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgatagttgtacttcgtgagctgtaagtg

SEQ ID NO: 59176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgatcctcctaacctgccggattttgcgg

SEQ ID NO: 59177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgatctagcgcttttgggccctgcctctt

SEQ ID NO: 59178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgattttcctaaaatgtgtgagggttgtg

SEQ ID NO: 59179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcaaaacgctggttaatggtggaaccgc

SEQ ID NO: 59180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcaacaagttcccgctctgccaccggcc

SEQ ID NO: 59181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcaattccggacgaggttgtttgttggg

SEQ ID NO: 59182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcacaagtccgtgttgaagggtcaaact

SEQ ID NO: 59183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcacacatgtcattctactcgttgagat

SEQ ID NO: 59184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcagaccgacttatattcacgagtttcg

SEQ ID NO: 59185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgccaaaggagatcttgtgcgtgcgctag

SEQ ID NO: 59186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgccaaggtggagaatagtagatgtggga

SEQ ID NO: 59187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgccatgatctgggcactactttatggaa

SEQ ID NO: 59188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcccctgttgatagcttccgttctacat

SEQ ID NO: 59189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcccgggggaattaaacttaaccagatc

SEQ ID NO: 59190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcccgtcgactcttcggtgtctcagtag

SEQ ID NO: 59191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgccctttagcgagattggcccttttgta

SEQ ID NO: 59192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgccgaacacactccatgctgtcaagaac

SEQ ID NO: 59193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcgaacccaatcgacttttcgacagtgc

SEQ ID NO: 59194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcgacccggctactaggcccctggcacc

SEQ ID NO: 59195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcgcccccattccaacatcgttcaaccg

SEQ ID NO: 59196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcgctactacacgtccatacgatcatct

SEQ ID NO: 59197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcggcgcccatggactcttagttatgcg

SEQ ID NO: 59198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcggttgcacatctcgttttcatgtctg

SEQ ID NO: 59199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgctaacattcgtgtgtccgagtccgggt

SEQ ID NO: 59200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgctctgagcgattaaattggacgtagat

SEQ ID NO: 59201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgctctgctaacagcatgacgtcaacccc

SEQ ID NO: 59202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgcttaccgctcgccatgagtcacgcgat

SEQ ID NO: 59203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggaaagctggccaagtgatgcataaccg

SEQ ID NO: 59204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggaagtggtagacagtgacgtgacgggt

SEQ ID NO: 59205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggatctcagtaggcgtatccagcccatc

SEQ ID NO: 59206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggcagatttgactcggggtctgatccgc

SEQ ID NO: 59207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggcggtcgaaaagtactttctgcccact

SEQ ID NO: 59208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggcgtaagttcgtatcgggggatggggc

SEQ ID NO: 59209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggcgtggacggggtgggttttcgctagc

SEQ ID NO: 59210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggcttccaggtgcgcttcagtgccatat

SEQ ID NO: 59211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgggacgatgaaccccgcaatgtcgacgg

SEQ ID NO: 59212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgggccgcaggataggcgctaaggattgt

SEQ ID NO: 59213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgggcgtacgagaatcccggaatgcggcg

SEQ ID NO: 59214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgggcttagtttccttggattcgcggctg

SEQ ID NO: 59215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgggcttctcttcagagggacagatattc

SEQ ID NO: 59216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggggctacggtattcctaaaggtgtagt

SEQ ID NO: 59217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgggtccagggtaatccaaccgtgaagct

SEQ ID NO: 59218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgggtgaatgcttcggtctcacatttgat

SEQ ID NO: 59219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgggtgatcgtacacgcagacctgaggta

SEQ ID NO: 59220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggtattgataggtcaggagttgggtggt

SEQ ID NO: 59221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggtcggggcagaacggcgccacatatcg

SEQ ID NO: 59222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggtgaacccagtacgtctcgccttcgta

SEQ ID NO: 59223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggtgcaagaggcctgagttagaccagcg

SEQ ID NO: 59224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggtggaatgtgaacgaatctcgacggca

SEQ ID NO: 59225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggttaaatggcaggatggggttgtcaca

SEQ ID NO: 59226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccggttaagggcggcgctgggaacggtgcg

SEQ ID NO: 59227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgtaactcctcaatctgtttgcagagcac

SEQ ID NO: 59228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgtacagtttatccaatagatgggggcct

SEQ ID NO: 59229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgtacataatcaccttttccgctatgtgt

SEQ ID NO: 59230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgtagcggcgtttgtcactttgtggtacg

SEQ ID NO: 59231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgtcgcattgctttatacgggcctaacgc

SEQ ID NO: 59232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgtgggctggggcgggtacgagcttgtgg

SEQ ID NO: 59233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgtgtaggtggtcattgtgaacccgcatc

SEQ ID NO: 59234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgttagtctgtctcgacagcatagttgcc

SEQ ID NO: 59235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgttgggcgcatacattcctggagctctg

SEQ ID NO: 59236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgtttcacctcgtcgattgctgagcttgg

SEQ ID NO: 59237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgtttggttgtagaaactaggaagtaata

SEQ ID NO: 59238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccgttttgactattcgcagtctcacccgcc

SEQ ID NO: 59239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctaacattgggatccgcagttgatgcgcc

SEQ ID NO: 59240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctaaccacatgtctcggcgtttttttcgg

SEQ ID NO: 59241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctacttcacagataacccgcgttcacgac

SEQ ID NO: 59242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctaggagacctacgagatggatattgcgc

SEQ ID NO: 59243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctaggtttaagataggaagcaccacccta

SEQ ID NO: 59244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctattgactggccatgcggtcggcatgct

SEQ ID NO: 59245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctcaatcaaagttggcttggatcgcccgt

SEQ ID NO: 59246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctcagacgttcgggacgctcggacaggtg

SEQ ID NO: 59247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctccgcacagttggaacccgccttacgaa

SEQ ID NO: 59248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctccgtgtccgtgtacaaatttgcggtag

SEQ ID NO: 59249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctcgcagatcgaggagttgggcggaacaa

SEQ ID NO: 59250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctcggcccctcaaaactgcgatttaccgt

SEQ ID NO: 59251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctcgtaaacgttggactgatgctcctaat

SEQ ID NO: 59252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctcgtttcatggtttatacgttcggcgcg

SEQ ID NO: 59253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctctcgctgagataccacaaccttacgcc

SEQ ID NO: 59254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctctcgttagtgcctttatgtggatcttt

SEQ ID NO: 59255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctctgggggctgttagttgccgttgaact

SEQ ID NO: 59256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgaagtatccgtactggctactgctctc

SEQ ID NO: 59257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgatcatgcatactcactgtgcggatcg

SEQ ID NO: 59258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgcagcgccgatttcgtggtttcatatc

SEQ ID NO: 59259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgcagctattctgtgcccactgttatgc

SEQ ID NO: 59260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgcgcctgtttcggcacacgtattgctt

SEQ ID NO: 59261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgctcggtcctcaatcacggttaaattt

SEQ ID NO: 59262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgctcgtctttaacaccggcgctaactc

SEQ ID NO: 59263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgctctccggtgtgggatttgaacgttg

SEQ ID NO: 59264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgctggcggaaactgcgtactcgttcac

SEQ ID NO: 59265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgctttacgactaagggacgtcggttac

SEQ ID NO: 59266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctggaactctcgattaattttacgttcga

SEQ ID NO: 59267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgtaagctcgggctcacagagaatcttt

SEQ ID NO: 59268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgtacacgaccggtggctagccaattgc

SEQ ID NO: 59269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgtaccgtccagacccggtgtccgtccc

SEQ ID NO: 59270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgtgcccggatagatcgtttactcgtag

SEQ ID NO: 59271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgttaaatagacgacaggtttggtgtgg

SEQ ID NO: 59272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctgttgctccagactgccatccttccgat

SEQ ID NO: 59273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccttaaggccggcgagggacgagtcgaatt

SEQ ID NO: 59274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccttaatcgcaatgatgtgttccatgtcct

SEQ ID NO: 59275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccttagtagttatacacacggcgttatggc

SEQ ID NO: 59276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccttatcagcataggcgaatcacgacccgg

SEQ ID NO: 59277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccttcattgttgttgcaggggggatcttat

SEQ ID NO: 59278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccttcgatggcctgtacaatacctggcggg

SEQ ID NO: 59279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccttggtagggaaggctacaggcgtgcgtt

SEQ ID NO: 59280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccttgtataggccgtccggtgggtaacgtt

SEQ ID NO: 59281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taccttgtccagcgtggatgttcggtctggac

SEQ ID NO: 59282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacctttagccgcgaccggccttgttaacttc

SEQ ID NO: 59283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaaaggcatttcaggacgcgtggccccaa

SEQ ID NO: 59284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaacaagtgagcggactaccgtctataga

SEQ ID NO: 59285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaacagatagcggccgtggtcatcgtgaa

SEQ ID NO: 59286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaaccgcactcttctgatttttacttcgc

SEQ ID NO: 59287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaaccgtacgtttaatcgggacgcgcacg

SEQ ID NO: 59288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaacgtatggcccaaacttccgtcctccc

SEQ ID NO: 59289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaagctgcaggctaccagtatccggtctt

SEQ ID NO: 59290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaaggatcatcgtcgggtagattggtacg

SEQ ID NO: 59291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaagggagccgaccacgagcaactaccac

SEQ ID NO: 59292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaaggggtgttaacgtcacggatcgaacg

SEQ ID NO: 59293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaagggtgttcgggcgtagattgctgcga

SEQ ID NO: 59294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaaggtgaccggtgctatatgaccgttgg

SEQ ID NO: 59295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaagttgttccccatgtctagccggactc

SEQ ID NO: 59296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaataaaaaactccgcgcccaccagagag

SEQ ID NO: 59297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaatagctaccggaccatggctcgtcatg

SEQ ID NO: 59298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaatttctataaccaatcgctctagacct

SEQ ID NO: 59299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgacagctagtatcctgtttcctaatgagg

SEQ ID NO: 59300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgacatgttgcactgatggtggcgtgggcg

SEQ ID NO: 59301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaccgctatttacggctcaggggtcatcc

SEQ ID NO: 59302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaccgctcgttgggttcagtgcacgggca

SEQ ID NO: 59303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgacgcaaggccggtgcaatgcaacagtgc

SEQ ID NO: 59304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgacgcacagggctctccacgcttggtttc

SEQ ID NO: 59305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgacgcgctaagccgggaagcggttggccc

SEQ ID NO: 59306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgacgcggtgtaaccctgagatcgtcgctg

SEQ ID NO: 59307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgacgggtagtcttggggttaacgcgctct

SEQ ID NO: 59308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgacgtgacgagtccgctgtttgcccgtat

SEQ ID NO: 59309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagcaccggaggtagctgagtctgcccgc

SEQ ID NO: 59310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagcagactactgtccttgatcgatcatc

SEQ ID NO: 59311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagcccggtcgataagacaggactgggga

SEQ ID NO: 59312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagccgggcagcgtcaggagttgttatga

SEQ ID NO: 59313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagccgtttcaccgtcgagaattgtttgc

SEQ ID NO: 59314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagcgcaggctaactcacttgtggtgggg

SEQ ID NO: 59315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagcggaatgcaggctgaatcatggctcc

SEQ ID NO: 59316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagctttggacgaacatggggtcaggtaa

SEQ ID NO: 59317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaggcaatgcaccgtgccatctccttggt

SEQ ID NO: 59318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagggattggaaactgttcccacctgccg

SEQ ID NO: 59319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagggggttagcgtcaatatgctgttcaa

SEQ ID NO: 59320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagggtgcaatgctcacgatccagactgc

SEQ ID NO: 59321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaggtaacaccttgcccagctgtccgatt

SEQ ID NO: 59322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgaggtagactatggaatgggcgagattcg

SEQ ID NO: 59323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagtcccaaattccttttaagccaagcgg

SEQ ID NO: 59324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgagttataccttcttacgccgtcgtatgc

SEQ ID NO: 59325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgataagcatgattacattcgaagcggcgc

SEQ ID NO: 59326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatacttcctctgtgactaggctgtcgag

SEQ ID NO: 59327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatatcgttacgggcgtgttgtttctccg

SEQ ID NO: 59328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatcaccgggctgtacgacgggtgcgggg

SEQ ID NO: 59329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatcatgctcgggttacatgggtattctt

SEQ ID NO: 59330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatccattcaccagcgctcatccgtactc

SEQ ID NO: 59331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatctctagcctcgtcggccggcgcgtcg

SEQ ID NO: 59332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatctgtcgcgggcggggggtggatcttc

SEQ ID NO: 59333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatcttcttaaagcctttcccggtatcac

SEQ ID NO: 59334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatctttggggagggtgggctaggattgg

SEQ ID NO: 59335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatgaatatgttcactgttttgggatcta

SEQ ID NO: 59336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatgatgtagttctcgaaaaacaatggtc

SEQ ID NO: 59337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatgcccactgtgactaatagcatagtct

SEQ ID NO: 59338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatgcgtgtcatcaccccatgatcggctt

SEQ ID NO: 59339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatggagtgttacgagtagtcgttccgtg

SEQ ID NO: 59340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatgggaatatgttgcgcgtgaatcagtt

SEQ ID NO: 59341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgatgttcgtattagcccgaagtactgata

SEQ ID NO: 59342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgattaacacaccagccgtcattgccaagg

SEQ ID NO: 59343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgattgagggtgttggacacggtaaccaaa

SEQ ID NO: 59344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcaaaagcttctcgatcactttacgggtt

SEQ ID NO: 59345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcaaccagaaccgtgtcacgcttgaagcg

SEQ ID NO: 59346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcaactaagcatgaaagctgtttcgtttc

SEQ ID NO: 59347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcaagatggctagtatttgctcactattg

SEQ ID NO: 59348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcaagccgcccgaagtgttgggtatgcct

SEQ ID NO: 59349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcaaggcatgtatccggctgtatcgcgct

SEQ ID NO: 59350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcaagtgtgaacttcggaccgcttcgttt

SEQ ID NO: 59351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcacacgggacggtggacatgcacacacc

SEQ ID NO: 59352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcaccggaacatagccatacgtttggacg

SEQ ID NO: 59353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcacctcttacccttcacccggatagcgg

SEQ ID NO: 59354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcacgggggtagaagtgttagttagcgtt

SEQ ID NO: 59355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcactcgagtatcgcccgttcgctgttgc

SEQ ID NO: 59356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcactgtttgtaggaagggtatgatcaat

SEQ ID NO: 59357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcagcacgttctcacacctggatggccgc

SEQ ID NO: 59358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcagcctccgagatacgtactttcttcca

SEQ ID NO: 59359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcagcgtcggggttttggggctgaaagag

SEQ ID NO: 59360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcaggattccggtccttctgcagtcaggg

SEQ ID NO: 59361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcaggccatctaccttcggcaggttgcgc

SEQ ID NO: 59362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcaggccttacaatcgctctcgggtagga

SEQ ID NO: 59363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcagggcccgtcgtgttgtcaaccgtgga

SEQ ID NO: 59364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcagtgattgccttatgctacacgcgcca

SEQ ID NO: 59365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcagtgttcttcattgcctgtcggtgcgt

SEQ ID NO: 59366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcagttcacccgctgctgctatacatccc

SEQ ID NO: 59367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcatatcgacgtgtcgtccggaatgtgcc

SEQ ID NO: 59368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcatcccgtgttttagttccgacgcccgg

SEQ ID NO: 59369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcatgtggactcgtaagacaggatctggc

SEQ ID NO: 59370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcatttagagatgtcaccgagggtcggtt

SEQ ID NO: 59371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcatttcgaccacgcgcatatcttgatgt

SEQ ID NO: 59372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcatttttgcacgacattcactataacac

SEQ ID NO: 59373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccaccagttttccacctagtcccgctgg

SEQ ID NO: 59374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccacctttgagcacgtgattacccccga

SEQ ID NO: 59375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccagcttgttacccatcccgcactattt

SEQ ID NO: 59376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccatacttgtaggtaacacgcgcgtggc

SEQ ID NO: 59377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcccaccaagcatacttcttactatcctt

SEQ ID NO: 59378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcccagagcttgtgtaagttccgcacgtc

SEQ ID NO: 59379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccccggattgtagttagtgtttttccgc

SEQ ID NO: 59380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcccgactttagaggcacttcctcgtccg

SEQ ID NO: 59381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcccgctcgccatcatagaccgaacaatc

SEQ ID NO: 59382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccctgatgaaggtagttttacccttggc

SEQ ID NO: 59383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccgaacatcaggaggagtccaagccgtc

SEQ ID NO: 59384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccgattacgagcttttgcgacgcagggt

SEQ ID NO: 59385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccgccgtctcggtcacctgagcttggcc

SEQ ID NO: 59386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccgcctgtgtacacgatccagctcatac

SEQ ID NO: 59387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccgctcgttgtttcggattgcagtgctc

SEQ ID NO: 59388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccgggcggcctaccgcttgtgggtctcg

SEQ ID NO: 59389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccgggctgccgaacgatgattctggatg

SEQ ID NO: 59390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgccgggggcctgctcgatgggatcggaac

SEQ ID NO: 59391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcctacgacgactggcgagaaatattggg

SEQ ID NO: 59392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcctccgtttagtcaatcacggttctccg

SEQ ID NO: 59393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcctctgtcgttcttgggctggccgccca

SEQ ID NO: 59394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcctgacgccgggatgacctacatcatgg

SEQ ID NO: 59395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcctgagtcaaacgctgccaccgtcggcg

SEQ ID NO: 59396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcctgcacgttgcgagttatattcaggca

SEQ ID NO: 59397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcctgcccacttgttaccagcacgcatgg

SEQ ID NO: 59398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcctgcggtagggcgttagtctttagttg

SEQ ID NO: 59399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcctggcttgaattgtgttgtagcgttta

SEQ ID NO: 59400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcctgtccacgaataaagccaggcttgcg

SEQ ID NO: 59401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcctgttacttatagtcatattccgggaa

SEQ ID NO: 59402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgaacgggcacaaatctagtttctcggg

SEQ ID NO: 59403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgaagtcgaggggtatgcgcggaaggga

SEQ ID NO: 59404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgagacgcgagttcggaataagcagtca

SEQ ID NO: 59405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgagggaacgcctggtacgagtggacga

SEQ ID NO: 59406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgccacaagctggatcacatatggcttg

SEQ ID NO: 59407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgccaggaccgctgatgcgactgactac

SEQ ID NO: 59408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgcccttccgcttggttcagtagggaag

SEQ ID NO: 59409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgccgggttaacctaggttatgcttcca

SEQ ID NO: 59410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgctacgtgagcaatgctggtggctctg

SEQ ID NO: 59411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcggaaggtcgtgccgtccggaatccgga

SEQ ID NO: 59412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcggacacatcggggaatactcatctatc

SEQ ID NO: 59413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcggacgtgtggggacacaaggggctact

SEQ ID NO: 59414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcggatctgttctaaagtcccgtaaattg

SEQ ID NO: 59415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcggcgctgaacaacacggggagctctgc

SEQ ID NO: 59416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcggcgtgttacccgtcaacacgttttag

SEQ ID NO: 59417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgggactgagggattataattgccgttc

SEQ ID NO: 59418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgggctgcagcttagctaccaggttatg

SEQ ID NO: 59419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcggtcgcacggattactcgtttgtagtc

SEQ ID NO: 59420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcggtctgctgttatcgtaggtatctgtt

SEQ ID NO: 59421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgtacgtgcatccaccgtgtttacgagt

SEQ ID NO: 59422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgtaggcgggctctggaccgggaggtca

SEQ ID NO: 59423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgtcaactagcgtcattactgcagtgtg

SEQ ID NO: 59424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgtcgagggagggtgtacacgatgctcg

SEQ ID NO: 59425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgtcgtagacgggacgagcatcaatggc

SEQ ID NO: 59426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgtgactccttctggtattgactattac

SEQ ID NO: 59427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcgttcctttctcaagtttgggtggtttg

SEQ ID NO: 59428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgctaaaattcggtgggacattctttacgt

SEQ ID NO: 59429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgctagatcgaactgtgaagcattgatccg

SEQ ID NO: 59430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgctatctaccaatactcctacttaatacc

SEQ ID NO: 59431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgctcaacacttattgtctggccgcgggcg

SEQ ID NO: 59432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgctcatcgtctatcatggcataattgtcg

SEQ ID NO: 59433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgctccatatgcatgcgaaccagggacact

SEQ ID NO: 59434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgctctaggccgtttccgccattggcacta

SEQ ID NO: 59435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgctgatacggtgtgttggctcaggcccgc

SEQ ID NO: 59436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgctgctggaatggaagcaactgatcaagc

SEQ ID NO: 59437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgctgtctggatgactggttttcgtctctt

SEQ ID NO: 59438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgctgtttcaggtggttacatctcaacgca

SEQ ID NO: 59439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcttcactatggtccccgggtactcgcct

SEQ ID NO: 59440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcttcgtatttgcgacaccggtgcccctc

SEQ ID NO: 59441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcttgccattgctttcagttccgtgcgtg

SEQ ID NO: 59442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgcttggcatcgattacagtatttgcaagt

SEQ ID NO: 59443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggaaggagtgcgatttcgtaaaaactgtc

SEQ ID NO: 59444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggaatactcaggctccccgagcttgtaac

SEQ ID NO: 59445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggaatgtatctcaaggttaccggggtagt

SEQ ID NO: 59446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggacaaccaggtttcaccacattagggtt

SEQ ID NO: 59447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggacgagcacggtctaactgcagtgcccc

SEQ ID NO: 59448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggacgccatatggcagttgcaggcctgct

SEQ ID NO: 59449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggacggcagcagagactttggatgtatgc

SEQ ID NO: 59450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggagaacaaggggtagcgccatatctcga

SEQ ID NO: 59451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggagcaacacgttccgtccgcgctgggcc

SEQ ID NO: 59452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggagcccgtgtcttttgaggcaccggagt

SEQ ID NO: 59453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggaggtgtaatggtgtgaagaatttgttg

SEQ ID NO: 59454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggagtcgaagggcttttaggcagccgacg

SEQ ID NO: 59455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggataacctgttcagggacggcagttctt

SEQ ID NO: 59456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggattacgcggcgtgtagccattatcttc

SEQ ID NO: 59457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcaaaatcgtcccacacgcgaaacgatg

SEQ ID NO: 59458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcacatctgttacgtcgtatcacagcgg

SEQ ID NO: 59459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcacgggtttcccggaaacgtcggtttt

SEQ ID NO: 59460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcacttgcaccagtatcacgcctaacgc

SEQ ID NO: 59461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcaggatgcgtgttcgacttgagttatt

SEQ ID NO: 59462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggccaagtgtcggagctcgtgagggtttc

SEQ ID NO: 59463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcccatggtccaactaggggtcctcgcc

SEQ ID NO: 59464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggccgggcggataaggcttgaatataggc

SEQ ID NO: 59465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcctagaggtctcgtatcgcgcttagtt

SEQ ID NO: 59466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcgagctaccgggtgggcggccggcaat

SEQ ID NO: 59467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcgatcctgttgggttagttcatagacg

SEQ ID NO: 59468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcgatgtccaaatagcaggcgttgtgca

SEQ ID NO: 59469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcgcatgcgtggctaaaagttatttcca

SEQ ID NO: 59470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcggaatcgagggacgcatttgcacggt

SEQ ID NO: 59471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcggacgtacttgtctcagaatagtgcg

SEQ ID NO: 59472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcggtggtataggattggtcacgggtgc

SEQ ID NO: 59473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcgttattgtttgcataggctacacaca

SEQ ID NO: 59474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggctagaattcccctagaaacaggtgtgc

SEQ ID NO: 59475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggctatttacttggctttttggtacctcg

SEQ ID NO: 59476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggctcgagtaggcacgggtgatggccgcg

SEQ ID NO: 59477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggctgccgttgggaggacattacgggtgg

SEQ ID NO: 59478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggctgttccatgcgcacccacaaggccct

SEQ ID NO: 59479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggcttagcggcggtatgtgccacttggcg

SEQ ID NO: 59480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggacgactacgtgagtgccgggtgctgg

SEQ ID NO: 59481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggagctacgtttagggccaaggtggtgt

SEQ ID NO: 59482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggagggatatgcggtaatacgtttggag

SEQ ID NO: 59483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggatcaatctttcgtgctgggcccttaa

SEQ ID NO: 59484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggatccgtcactgcgatttctcactttg

SEQ ID NO: 59485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggcatgccatacctgatcaacatctaac

SEQ ID NO: 59486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggcggtgttacgaattagtctgggcacg

SEQ ID NO: 59487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggctgcgtcaaggcaattcggcgaaccg

SEQ ID NO: 59488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggggaatgccggtcaccctcatacagttc

SEQ ID NO: 59489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggggaatggttcatccgcttagctcttcc

SEQ ID NO: 59490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggggagggtcccaaggcgagctactacga

SEQ ID NO: 59491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggggcagaaaatcaacggtcccaatgcga

SEQ ID NO: 59492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggggcctgacagttcttgactacctttgg

SEQ ID NO: 59493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggggcgtttgtttgagggccgcctctggt

SEQ ID NO: 59494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggggaatcttctgaatgtatgccctgat

SEQ ID NO: 59495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggggatctcgctcgtagactggctttgg

SEQ ID NO: 59496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggggctgcatctgactatacatgagcgc

SEQ ID NO: 59497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggggcttatcagtctaatggttgtacgg

SEQ ID NO: 59498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggggggacactgcatgaacgagggcgctt

SEQ ID NO: 59499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggggtttgtgctgttaagaagtttgttaa

SEQ ID NO: 59500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggtgcctcggctagagagcggtgccccg

SEQ ID NO: 59501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggtgctatccttgaacgttcctgtattg

SEQ ID NO: 59502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggtggcttgaattgtgatttgtcagtct

SEQ ID NO: 59503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggtgtctttagcccacctctttactttt

SEQ ID NO: 59504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgggtgtgcctgtcgggaagagctggtgcg

SEQ ID NO: 59505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtaaagtttttggcatataagagcgagc

SEQ ID NO: 59506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtaacgcacacgtcataaggatgtcaca

SEQ ID NO: 59507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtaagatagcacgggcaaggggtcgggc

SEQ ID NO: 59508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtacgtatagcaccttaggcatcggtgg

SEQ ID NO: 59509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtactggctacgtctccgtacgactgtg

SEQ ID NO: 59510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtagaagggcgggttgtgcttagtggct

SEQ ID NO: 59511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtatcaccaatctgttgcccgaggacgt

SEQ ID NO: 59512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtatgggcggcgcgtctcagaaatttat

SEQ ID NO: 59513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtccgtgtaagagaaagagtggggggcg

SEQ ID NO: 59514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtccttccagcgttgcgttagaccctgc

SEQ ID NO: 59515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtcgagtgaagttgagcatgtccgggcc

SEQ ID NO: 59516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtcgcgcgaaccttctcttcgcctctgt

SEQ ID NO: 59517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtcgctggtgctacaaaaatgggctcca

SEQ ID NO: 59518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtcggagaggtgcacgggcccggcgttg

SEQ ID NO: 59519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtcgggacattcttcgcctaagttggcg

SEQ ID NO: 59520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtctgttagactaatcggccgacctcca

SEQ ID NO: 59521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtcttacgtgtgaagctgaactatggac

SEQ ID NO: 59522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtcttgatcaggcgaaggctaatgatac

SEQ ID NO: 59523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtgacgttcagaattgaaatcgccgcgg

SEQ ID NO: 59524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtgcagagattataactaagatcagccg

SEQ ID NO: 59525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtgccatggccagttgttttcgtcagcg

SEQ ID NO: 59526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtgtcgggtccgtttcgagtctgcaatg

SEQ ID NO: 59527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtgttgcgttctgcgtgtcctgctactc

SEQ ID NO: 59528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggttactccggagccggcgggcctatctg

SEQ ID NO: 59529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggttagagtacagttggcgcgtttcgatt

SEQ ID NO: 59530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggttatggagccacacaggagtgggtgta

SEQ ID NO: 59531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacggtttcagcatgcccttataaggggtcca

SEQ ID NO: 59532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtaaacggcgcttaataatactgttcgtt

SEQ ID NO: 59533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtaaccagtctccccatcctatatctggt

SEQ ID NO: 59534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtaacgtagaacgacgagtctgaggatcg

SEQ ID NO: 59535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtaagcccgggctgatcatactgtcggcc

SEQ ID NO: 59536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtaagcgcatacatcgaaaggcggtggtg

SEQ ID NO: 59537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtaatcgcgggacgtggtcagcggtccgg

SEQ ID NO: 59538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtacagaatcgtatgcgctggttaaggtg

SEQ ID NO: 59539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtaccgggagccaagccttggcagcctgc

SEQ ID NO: 59540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtaccgtggttattcgttctcggcagcat

SEQ ID NO: 59541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtacgttctggggtttagatggttcgacg

SEQ ID NO: 59542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtactacacggtggcgcgcgtcttttttc

SEQ ID NO: 59543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtactcaccgaacatgggttcttatcgcc

SEQ ID NO: 59544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtactgaaggttgcacatgaccaaaggct

SEQ ID NO: 59545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtagcccagtcagcactacgcgatgtggt

SEQ ID NO: 59546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtaggcacacccgggtggttgcttcgcga

SEQ ID NO: 59547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtagggatagttgtatcgaccagcatgtt

SEQ ID NO: 59548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtagtgctgcagacgtgttactggaacct

SEQ ID NO: 59549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtatacaccaccggccgtgggttgtgaag

SEQ ID NO: 59550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtatcaagttggtgccaatctatacggta

SEQ ID NO: 59551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtatgacggacagctcgtactcgcaggac

SEQ ID NO: 59552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtatgcagacacagtggctcccgatggta

SEQ ID NO: 59553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtatggacagatattttggtccatggcac

SEQ ID NO: 59554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcactgagtttttccggattaatctagt

SEQ ID NO: 59555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtccatgttcacgggtgtaagtagtgccg

SEQ ID NO: 59556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcccaaatgcgccgtagcgtcagcaaga

SEQ ID NO: 59557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtccgatacgatggtgcacaggttcgtgt

SEQ ID NO: 59558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtccgccaaaataatcgaatgacatcctc

SEQ ID NO: 59559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcctgtggggttcggaacaagtccatat

SEQ ID NO: 59560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcgaatcataaagatttagtatgcggaa

SEQ ID NO: 59561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcgagtgttaagatgtctcgcctacgcg

SEQ ID NO: 59562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcgatctgtgtgtctttgaaggttccct

SEQ ID NO: 59563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcgcattcgtgatgattgggtatggtgg

SEQ ID NO: 59564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcgccggggattggacctggattatgca

SEQ ID NO: 59565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcgcgatgttgattggggaacaaatgcc

SEQ ID NO: 59566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcggcagctatatagttcttatttactt

SEQ ID NO: 59567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcggtattcagagttagtcactcggcat

SEQ ID NO: 59568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtcttccgttgaagttctggacgatgtta

SEQ ID NO: 59569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgaagggctccccgtccctcatatcctc

SEQ ID NO: 59570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgaccagtcggacgctgaactcccgaat

SEQ ID NO: 59571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgatatgtctacggaaacccgtcgtgtt

SEQ ID NO: 59572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgatcgttcgcctagacaagccccatgt

SEQ ID NO: 59573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgcatggcgcagtgtcccgcgacagtcc

SEQ ID NO: 59574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgccatgtaactcggaggcctgggcgga

SEQ ID NO: 59575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgccgagagttaacacctggcgcggcat

SEQ ID NO: 59576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgcgacgtatccgcggacagcatgactt

SEQ ID NO: 59577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgcgcacattcccatgctcggccggtcg

SEQ ID NO: 59578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgctagagcattgcggaaggacgggttc

SEQ ID NO: 59579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgctttcaccctatactcttcgttcatt

SEQ ID NO: 59580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtggaaactagtttagaagttttgttggt

SEQ ID NO: 59581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtggaatcgatagtctacccggcttctcc

SEQ ID NO: 59582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtggaatggcggtggacttacgttggtgc

SEQ ID NO: 59583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtggcaacaatccctgctagtgcttcgaa

SEQ ID NO: 59584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtggcatatgatacagtcctgcccttatg

SEQ ID NO: 59585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtggcgtcagatgaattgatgcggacatg

SEQ ID NO: 59586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtggcttcgattattcacatgcgctctgc

SEQ ID NO: 59587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtggggtggtcggtagatgagtggggagc

SEQ ID NO: 59588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtggtccttgtcagccgcgacgctatcac

SEQ ID NO: 59589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgtatgttaaccctcctggcgctttcaa

SEQ ID NO: 59590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgtcgttatctaggagtcccagggcggc

SEQ ID NO: 59591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgtgggggtaactgtctcagcggtgcgc

SEQ ID NO: 59592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtgtttacggaatccgcacgggagcgttg

SEQ ID NO: 59593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttaacaccacgacggtaccggcatctgg

SEQ ID NO: 59594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttaacgggtcgccagaagaggccgcggg

SEQ ID NO: 59595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttaactagttagaacgtgtttatcgtct

SEQ ID NO: 59596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttaaggctcgggggaccggtcgctgggg

SEQ ID NO: 59597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttacatcgggcgatcgactgtcctgcgg

SEQ ID NO: 59598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttagactgcattgcggttaagggcacga

SEQ ID NO: 59599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttatttccactaatgatgggttatgtca

SEQ ID NO: 59600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttcagtttttatcggtatggtacggcaa

SEQ ID NO: 59601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttccggtccgtatgcggcggagtctggc

SEQ ID NO: 59602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttcgcaaagccccggcgccgctttcagt

SEQ ID NO: 59603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttcgcccggaccacgatctcgcctcggt

SEQ ID NO: 59604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttcggcgggaaacgcttcatttggaaca

SEQ ID NO: 59605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttctcggacatagattcggtatctcggt

SEQ ID NO: 59606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttcttcttacggaggggagttgtgctaa

SEQ ID NO: 59607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttgatctaacttaagattaattgcggat

SEQ ID NO: 59608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttgctttgggcatcggttcacacgtgct

SEQ ID NO: 59609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttggactggattacgatgggcccgcggc

SEQ ID NO: 59610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttggatatctgttacgctacgaagactc

SEQ ID NO: 59611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttggcgggcttcctcgcagacttgccgt

SEQ ID NO: 59612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttgggcatgtggttatccgagccccatg

SEQ ID NO: 59613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttgtccccgcccttactttctctatcgg

SEQ ID NO: 59614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgttgtcgacatataacagccgatggggat

SEQ ID NO: 59615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtttcccgaagcagtagagtttggggtcc

SEQ ID NO: 59616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtttcgaccgaatctctgcgcgcttttgt

SEQ ID NO: 59617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtttcgggttaaatcaggtgtgggacgca

SEQ ID NO: 59618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtttgatcacacggctgggaggtggcaga

SEQ ID NO: 59619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtttgatctgcattccccatgcttacgca

SEQ ID NO: 59620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacgtttggtggactgctaccttatcggtgtc

SEQ ID NO: 59621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaaacccgtttgcacatcggcatttttcc

SEQ ID NO: 59622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaacgcaaatggcgcaaaggctttgctgc

SEQ ID NO: 59623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaactcgacactagttgcattcacgcggg

SEQ ID NO: 59624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaagagaagtggctcagtcctgttcaacg

SEQ ID NO: 59625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaagatgggaatcgtgggttcgacgcggt

SEQ ID NO: 59626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaagcatgtccggaagtgttggacgtgca

SEQ ID NO: 59627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactacatggctatttatcctaccccccgcgc

SEQ ID NO: 59628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactacatgggccgccaactcactagctttct

SEQ ID NO: 59629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaccaagtcccgctagcgctatcctgggc

SEQ ID NO: 59630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaccactcgcaataacaactggcgcgaga

SEQ ID NO: 59631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactacccactctagcatgcgagccgtgatac

SEQ ID NO: 59632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactacgggcgcactctatgcagaaaacacat

SEQ ID NO: 59633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactactcgtgaggaatgccttgtgcagtgct

SEQ ID NO: 59634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactactgcgccctttgtaaatcctcctccgc

SEQ ID NO: 59635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactactgttttgggggtggactgtttgtctc

SEQ ID NO: 59636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactacttctccttagaataaccagtactcct

SEQ ID NO: 59637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactacttgggacgaagggtttttcggactat

SEQ ID NO: 59638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactagagtagggcctttcctggttagtcctt

SEQ ID NO: 59639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactagatgcagctcaatcttgacatggcctg

SEQ ID NO: 59640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactagcatgttgtacggtgacaggtaacggt

SEQ ID NO: 59641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactagccgggcagctcgggcttccgtgggta

SEQ ID NO: 59642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaggaagtagtccctcgctataaggtgtc

SEQ ID NO: 59643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaggactctgaacggttccatcggcgcca

SEQ ID NO: 59644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaggaggtcctgttaattgaaatactgcc

SEQ ID NO: 59645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactaggttggggtcactccatgcattccagc

SEQ ID NO: 59646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactagtctaacggggggttaccggctgcacg

SEQ ID NO: 59647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactagttgggcattcgcggtagcatcgcggg

SEQ ID NO: 59648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactagtttaaatcgagcatatggcaacgtaa

SEQ ID NO: 59649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactagtttaacagtgttctatctactcacgc

SEQ ID NO: 59650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactataaagggagtggggtaggaggatgaag

SEQ ID NO: 59651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactatactcggttggctcggggactgggtgg

SEQ ID NO: 59652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactatagattttaaactgtctgtgtatcgct

SEQ ID NO: 59653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactatccgagggcgcgcagatctccgtacgt

SEQ ID NO: 59654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactatcggttgctcccgcctggcaagaagtc

SEQ ID NO: 59655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactatgatcctagagtcaagttggaccgaca

SEQ ID NO: 59656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactatgtggcttgttcggaatgattatcatt

SEQ ID NO: 59657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactattcgagatctagtcggtgcaaaaccta

SEQ ID NO: 59658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactattgaaccggagtcgacaaacggatgct

SEQ ID NO: 59659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactattgtgttgaacatctcgggtttgcggg

SEQ ID NO: 59660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcaactggcgctatctgcagtctctcccc

SEQ ID NO: 59661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcaagtatgatctggcggtggtggctctg

SEQ ID NO: 59662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcaatccccggctaactacacactgcgac

SEQ ID NO: 59663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcaatgcccaatacctgcgggtgcgcggc

SEQ ID NO: 59664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcaccttggtccgcgcccgtatcaccagg

SEQ ID NO: 59665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcaggcagtctttccaagttgggacgtga

SEQ ID NO: 59666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcaggtttgattctccggggggcccgttt

SEQ ID NO: 59667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcatgctaacagtacggatatcccccttc

SEQ ID NO: 59668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcatgtgcaccgccttagtgacacaacca

SEQ ID NO: 59669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcattagctcttaccgctcttggttgagt

SEQ ID NO: 59670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcattgttcactcagacgcgcagacactg

SEQ ID NO: 59671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactccacagtatttgacgaaacatgagtcct

SEQ ID NO: 59672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactccagcacggggggggagggggcgtatcg

SEQ ID NO: 59673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactccataggcgatggatttcggagaagggt

SEQ ID NO: 59674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactccatccttggtcgtcgtagcagttgacc

SEQ ID NO: 59675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactccatcgaggtatgggtcatgcgcccctg

SEQ ID NO: 59676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcccaactgtcccgtactccacttaatcg

SEQ ID NO: 59677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcccgttagtcatgctcgtatgactttgg

SEQ ID NO: 59678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactccgacatgatacccgtccggcacgtctt

SEQ ID NO: 59679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactccgatagcacaactgcgcgggtcgcaaa

SEQ ID NO: 59680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactccggacagtagctactgtagacaatgcc

SEQ ID NO: 59681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactccggcagatcatagttgatcattctcca

SEQ ID NO: 59682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactccttgttgtacgctcttcgcggtttaca

SEQ ID NO: 59683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgacggtcggttgctatcacgcgttctc

SEQ ID NO: 59684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgaggttcgccatagtgtaagctgccgg

SEQ ID NO: 59685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgatgttggtcggttaagctcaaacaat

SEQ ID NO: 59686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgcgcgcccggcatggtcttgtcacacc

SEQ ID NO: 59687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgcgcgggtgctaaggctagttggatgg

SEQ ID NO: 59688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgcggcgggcctcacagctgctatcgcg

SEQ ID NO: 59689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgcttcacgttcgtttagcccgtccggg

SEQ ID NO: 59690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcggaacgcgtgatggagttggatgagac

SEQ ID NO: 59691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcggacggattaacgtggttgatatcgcg

SEQ ID NO: 59692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcggcagattcctgtttggatgtcacgcg

SEQ ID NO: 59693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgggagcttatgcctatagtcacttagg

SEQ ID NO: 59694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgggagtcaccccttctcctcaaggcgg

SEQ ID NO: 59695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcggtcagcatgcacgtgctcgtttataa

SEQ ID NO: 59696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgtacacatagcatcgcactcaattcca

SEQ ID NO: 59697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgtgataaatgtagcaatcgaggcatgc

SEQ ID NO: 59698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgtgctgcttggctccaaatcccctttg

SEQ ID NO: 59699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgtggcttgcggtttcgcgaatgttgta

SEQ ID NO: 59700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgttcggggacttggtgggcacgtcacc

SEQ ID NO: 59701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcgttttcggcggtggctatacaggtaac

SEQ ID NO: 59702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactctagggcccatgggctagcggatgattc

SEQ ID NO: 59703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactctccattgatgcggctctacatctccct

SEQ ID NO: 59704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactctccccaggagtgcgcaattagtatgtg

SEQ ID NO: 59705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactctcgacggtccaccgtattgatattggg

SEQ ID NO: 59706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactctcgttgaagtttgcggttatcaggggc

SEQ ID NO: 59707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactctgactgaagcgctggtccacctctcgg

SEQ ID NO: 59708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactctgggtggacattgatacaagctagctg

SEQ ID NO: 59709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactctgtctggttcgttggcgattataagat

SEQ ID NO: 59710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcttgcgcgtttgcttcccactagccagc

SEQ ID NO: 59711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactctttcttggatcacgctgtccattggca

SEQ ID NO: 59712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactcttttcataactcatggatgtctccgct

SEQ ID NO: 59713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgaactgactcggccagcccaagtgagcg

SEQ ID NO: 59714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgaatggtgtccagtgggagcgtatcaca

SEQ ID NO: 59715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgacaaatcctactttcacggaagcccat

SEQ ID NO: 59716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgacgggctcttccggtatcgttggccgg

SEQ ID NO: 59717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgatcgcgttagacgggggactattcaca

SEQ ID NO: 59718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgatcggcgacgtcttgcggggaatgatg

SEQ ID NO: 59719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgatctaatggtatgcgaaaggcccgacg

SEQ ID NO: 59720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgatgagcagcggagcggatgcggttgtg

SEQ ID NO: 59721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgatgatccagtgcgatgccgagataaat

SEQ ID NO: 59722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgatttgaggtctctgcagttcgggtggg

SEQ ID NO: 59723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgcaatctggcctgcttccttcacatcgg

SEQ ID NO: 59724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgcactcctatccgttgcaaatacaccgc

SEQ ID NO: 59725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgcccactcgaggtaattcgttaggttcc

SEQ ID NO: 59726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgcgaatcaccgactcatgggggtcgcaa

SEQ ID NO: 59727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgcggctggaaccggacgttggaatggta

SEQ ID NO: 59728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgcgtccagcgcaatcgtgaggagacgta

SEQ ID NO: 59729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgcttaactgggacgacttgttgggggat

SEQ ID NO: 59730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggacgtctggagggtcgagctctgggtg

SEQ ID NO: 59731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggactccgctaagcactgttatggcgcc

SEQ ID NO: 59732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggagagggcaattgcttgacgaagtcat

SEQ ID NO: 59733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggatcgtgcaagtgctaaaatctctgtg

SEQ ID NO: 59734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggcataaccgcgccatagttgaggaatg

SEQ ID NO: 59735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggcgcttgggacagctgcgattaccggt

SEQ ID NO: 59736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggcggaaccttgcgtaaacatcccgtcg

SEQ ID NO: 59737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggcggcgttttcccgttcggacgcaagt

SEQ ID NO: 59738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggctctggcacggaaaaggacagccatt

SEQ ID NO: 59739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgggcaggtttattggcccatgagtcgct

SEQ ID NO: 59740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgggcctacaggacagggaagatgtttct

SEQ ID NO: 59741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggggtgtatctattttacagagatccgc

SEQ ID NO: 59742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgggtcaagggatgcttcagaaagcggac

SEQ ID NO: 59743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggtactgtcgcggacaggatcactggat

SEQ ID NO: 59744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggtcaatgcttcggctcgaaatggcacc

SEQ ID NO: 59745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggtgacctcaaacgaaaggcccagcttg

SEQ ID NO: 59746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggtgccgggcgtcggggcgtccttagcg

SEQ ID NO: 59747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggtgctacttcgcctataccgccatgtc

SEQ ID NO: 59748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactggttgtctttgcttgaggtatggaagtt

SEQ ID NO: 59749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtacctctctcatgacatcactgtccgt

SEQ ID NO: 59750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtactcgggaccgaacccgacttaatct

SEQ ID NO: 59751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtatcaaactaagataattgagcgatca

SEQ ID NO: 59752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtattgtcacctgtgtttctggtctacg

SEQ ID NO: 59753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtccgaagtaactagattcggcgtctcg

SEQ ID NO: 59754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtgcacaggtgggcgagagaggtcggtc

SEQ ID NO: 59755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtgcattcagtcttgctatggcagccat

SEQ ID NO: 59756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtgccctaccccgacacgccatgtctga

SEQ ID NO: 59757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtggtttaggttgttcggcgtgcccata

SEQ ID NO: 59758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtgtaatttaaaatatggattatgaagg

SEQ ID NO: 59759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtgtgggctggggcgacgtccgacgatg

SEQ ID NO: 59760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgtgttcgaacctggatcgttctgagctt

SEQ ID NO: 59761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgttgggcgcgtgggcggcaggctgacgg

SEQ ID NO: 59762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactgttgtcctgaacctgacgattacgggta

SEQ ID NO: 59763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttaactgggttagcttaccatgcctagca

SEQ ID NO: 59764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttaacttggttagggcttgcgcaagggtc

SEQ ID NO: 59765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttaatcaggatgccgtgtgcgcatgcgtc

SEQ ID NO: 59766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttacatgtgccggtagacctaaccgtctc

SEQ ID NO: 59767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttacgcagctctaaaaggccctagtgact

SEQ ID NO: 59768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttacggatgaactcttgccaagccggtga

SEQ ID NO: 59769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttactacggtatacctgcacacatcgact

SEQ ID NO: 59770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttagactaccattgatccgggatcgtggg

SEQ ID NO: 59771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttagaggcggtcgcatggtcgtgcgcgtg

SEQ ID NO: 59772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttagcaacaatccgggccatctggttcct

SEQ ID NO: 59773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttagcaaggatgcaggtaagtcgtaaata

SEQ ID NO: 59774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttattaatagcgagcgtgagtggcccaaa

SEQ ID NO: 59775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttattgatgggcactagtgggaaaacgcg

SEQ ID NO: 59776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttcagcttaaatgtgaacctgggtttacg

SEQ ID NO: 59777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttccagttcatataatcgccgctccccgt

SEQ ID NO: 59778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttccggtaccatccgggggttgttgtgtc

SEQ ID NO: 59779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttcctgaacgttaatggtgaggggtttat

SEQ ID NO: 59780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttcctgtttgatcttgcttgaccatgatg

SEQ ID NO: 59781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttccttttcgtgacctccctcgctatgaa

SEQ ID NO: 59782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttcgacggggtaacgcatttatcggtgag

SEQ ID NO: 59783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttcgcacagggtggccaaagtctttcacg

SEQ ID NO: 59784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttcgtggacgtgaacctgatacctacaat

SEQ ID NO: 59785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttctactatgagtcccctcgaggctcgac

SEQ ID NO: 59786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttctggatgcaacataagtctctggttgc

SEQ ID NO: 59787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttcttgctgtttagtaggctttgatgtcg

SEQ ID NO: 59788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgagacttgcaattgacttggcccgtat

SEQ ID NO: 59789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgattgcactgttatgttctaagcgttc

SEQ ID NO: 59790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgcaaaaacgatctcgcaccggcatcgg

SEQ ID NO: 59791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgcccgcatcacacgttgttgattgggt

SEQ ID NO: 59792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgccgccgagcgatacaacaggcttacg

SEQ ID NO: 59793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgccttctacacataaacaactgggcga

SEQ ID NO: 59794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgcggcgacgactctccacttgctagga

SEQ ID NO: 59795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgcgggcgagcacgtgttttagtctctc

SEQ ID NO: 59796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttggatattcaggagagttaggcctgcgc

SEQ ID NO: 59797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgggggagcgacataacatcctgtctct

SEQ ID NO: 59798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttggtagcgcgtggaaaggttaaaaccta

SEQ ID NO: 59799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttggtcaaggttagcgtgattatgctgtc

SEQ ID NO: 59800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttggtccaagagcttccctctacgggcga

SEQ ID NO: 59801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgtactttgggcgcgcaggttaaccgcc

SEQ ID NO: 59802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgtgcccactcgctaacgaacagttcga

SEQ ID NO: 59803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttgttggattcatacggctgtaggccaga

SEQ ID NO: 59804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactttaacgcattccatgggcgggtttatgg

SEQ ID NO: 59805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactttacgggggccttgttggcttcgaccgc

SEQ ID NO: 59806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactttatggcatccctgaagacgagacttcc

SEQ ID NO: 59807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactttcatactgccatactagtagggtgcgg

SEQ ID NO: 59808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactttcccggtcgtttatagtcctatgtttg

SEQ ID NO: 59809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactttgagttacccttgataatggccgtctg

SEQ ID NO: 59810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactttgatcatcagacttgttgcacatacag

SEQ ID NO: 59811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactttgcccgacgcagtcgtacttgctctac

SEQ ID NO: 59812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactttgcctgtggctcatcggttgtgatgta

SEQ ID NO: 59813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttttccactcgcgggaccagcctttgcgc

SEQ ID NO: 59814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttttccggggggattatttcttgcgtccc

SEQ ID NO: 59815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tacttttgttaaccttgacttattgggtcagc

SEQ ID NO: 59816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tactttttcatgaccggccggggcctttaccg

SEQ ID NO: 59817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaaaaggtctgaacgccataaacacaagtt

SEQ ID NO: 59818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaaagcactaacgcatcgatagaatctagc

SEQ ID NO: 59819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaaatgagagagttggtactacggactttt

SEQ ID NO: 59820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaacaggatcagcgtgcggcatcaacgctt

SEQ ID NO: 59821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaacataagtgccggttcggtggcgaggcg

SEQ ID NO: 59822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaaccccggcatgattggagttaatcgtgt

SEQ ID NO: 59823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaacccggacatctctcgtcagtcgtaggc

SEQ ID NO: 59824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaacgcgtggaggtcacggactaaccccga

SEQ ID NO: 59825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaactaaactgtctcgaaatctttattaaa

SEQ ID NO: 59826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaactgccgctgccctccgaggggttgtgg

SEQ ID NO: 59827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagaactgggtcgtgtaagtgacgtctta

SEQ ID NO: 59828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagacagcagggtcgctgatcgagcgtcg

SEQ ID NO: 59829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagacattcgagtcttttgacacatctcg

SEQ ID NO: 59830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagagccgcagcggaaacgggcttgaatg

SEQ ID NO: 59831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagagctggcaaaacactactttgtaaaa

SEQ ID NO: 59832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagatctggagaaatgttgaagcggtgtg

SEQ ID NO: 59833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagcatggtatggccggactcaatacttg

SEQ ID NO: 59834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagccccctcggttgtttcccgtgcaact

SEQ ID NO: 59835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagcgataagccgccgtttgattatttca

SEQ ID NO: 59836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagcggagttaccgcgcacaggagtggtg

SEQ ID NO: 59837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagcggcttacggatgaaatactgatgcg

SEQ ID NO: 59838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagcgggtccctcgtcctgtagcgcgcgc

SEQ ID NO: 59839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaaggaaacgcgcgtatcacatctcacttt

SEQ ID NO: 59840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaaggccatctcaacctaagctccgtttgt

SEQ ID NO: 59841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaaggcggtcacactccgaatatggttagg

SEQ ID NO: 59842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagggacacttagctttggttaagtcatc

SEQ ID NO: 59843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagggtctggtagggacgttcgcgatcta

SEQ ID NO: 59844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagtgtccgcctgcgagtatgttgcactt

SEQ ID NO: 59845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagttcaattaacggggattagagcagca

SEQ ID NO: 59846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaagttgtcgcgttcgagttctattacccc

SEQ ID NO: 59847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaatcatgacttcccatagactttggcatt

SEQ ID NO: 59848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaatccgcagttgctaacagtgcccctcaa

SEQ ID NO: 59849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaatcgccggctggcgttttagcccgtcct

SEQ ID NO: 59850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaatctgaagcgtgggacaagctaactttc

SEQ ID NO: 59851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaatggcctagtagattggtacctgcacgt

SEQ ID NO: 59852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacaaaaatagcttgggatgggtctttggg

SEQ ID NO: 59853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacaaaggccgatacatccaatttaataat

SEQ ID NO: 59854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacaacctgtgtgagcagtaatatcgcgtg

SEQ ID NO: 59855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacaagcggacaggttcaaacaggagttcg

SEQ ID NO: 59856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacacagaccaggttcgggtaacggtgccc

SEQ ID NO: 59857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacacccccgctctaagcatgtcagttgca

SEQ ID NO: 59858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacacccctatgtcccgcagacttcattta

SEQ ID NO: 59859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacacgctaatgcacagtgcgggttgtcct

SEQ ID NO: 59860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacacgggacatatcggagaaggttacggg

SEQ ID NO: 59861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacacgttgctgtccgtgatcagaacgttc

SEQ ID NO: 59862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacacttgtgctcgcgtccatatccgcaac

SEQ ID NO: 59863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacaggcgtggttaataccagtcttaggag

SEQ ID NO: 59864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacaggttgttttgatgcgttatcaaatgc

SEQ ID NO: 59865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacatgcattacctggttattacacgtcca

SEQ ID NO: 59866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacatgcgtgtattgcccctcacggcaccg

SEQ ID NO: 59867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacatggatcgggcaccagggcgggaggtt

SEQ ID NO: 59868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaccaagacagcacgttgaggcaggacgcc

SEQ ID NO: 59869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaccaatgttatcccggtatgatcgctaaa

SEQ ID NO: 59870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaccacccaggcttaatgtgcggctttgag

SEQ ID NO: 59871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaccaccggaccggtatgcgatcgccacac

SEQ ID NO: 59872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacccggctcggacgatagtatactcgttc

SEQ ID NO: 59873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaccctcccttgagcggcaaacgcgtaacg

SEQ ID NO: 59874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaccgcagctcggaccgtggggcgttcgtc

SEQ ID NO: 59875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaccggccctgtgtgcgtccaccgatcacg

SEQ ID NO: 59876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaccggttagaagccttagagattcggtca

SEQ ID NO: 59877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaccgttggttacaaagatgtgatcggcgg

SEQ ID NO: 59878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacctttgcagtgtgacgcaataccatccc

SEQ ID NO: 59879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacgaaaccggagtctcgtgtgtgttattg

SEQ ID NO: 59880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacgacggaaatgagggtgcagtacgtttg

SEQ ID NO: 59881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacgagagtattgctgccgcaccgtcgcca

SEQ ID NO: 59882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacgagatgtaaaccgtattctgtttgtgg

SEQ ID NO: 59883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacgcaacgggcaatcaagcgaagtaccgt

SEQ ID NO: 59884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacgccttggtctgtggtgtaccggagtgc

SEQ ID NO: 59885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacgggtattatcgtggctcgcttggtctc

SEQ ID NO: 59886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacggtagacggtttctgggctactctttg

SEQ ID NO: 59887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacgtaaatgatgatcgtcatttgactctg

SEQ ID NO: 59888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacgtgagtcctggcattaggggctccgtg

SEQ ID NO: 59889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacgtgcctttaaatccttcaatgagagga

SEQ ID NO: 59890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagactaagattccgtcaacatcttctttccg

SEQ ID NO: 59891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagactaggcagctgaaggataagcggcgccc

SEQ ID NO: 59892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagactatgcggtagtatactacttccggctg

SEQ ID NO: 59893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagactccgactggtaccctttgcacctggtc

SEQ ID NO: 59894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagactcgaagtgcacgaaataggcctgtact

SEQ ID NO: 59895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagactcgccaagacatagggggaacgtttat

SEQ ID NO: 59896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagactggaactataggcgcccagttgtctgg

SEQ ID NO: 59897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagactgtaaacggtctctaggccatccgcct

SEQ ID NO: 59898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagactgtttaatttttgtacgagttgtttag

SEQ ID NO: 59899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagacttcaactgggtcgcggggactggtaaa

SEQ ID NO: 59900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagaaggcgctactatcgacaaggtcttat

SEQ ID NO: 59901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagaagtgttcatcaactccttgatttttc

SEQ ID NO: 59902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagaagtttaactcattattgactcttaac

SEQ ID NO: 59903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagacgtatgttatggggagaagtgtagag

SEQ ID NO: 59904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagacgtctggcaacaaggttatttaacca

SEQ ID NO: 59905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagagaggtggcgagccgccgataggccat

SEQ ID NO: 59906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagagcgaaggggagtggttttgcgtcgct

SEQ ID NO: 59907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagatccgctgggcgtagcgtaggtgagag

SEQ ID NO: 59908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagatgttcatggtatgttcatggctgccc

SEQ ID NO: 59909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagattagcggcgatgacacaccagcgaat

SEQ ID NO: 59910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcaacgctttttgcgagattatgcttgc

SEQ ID NO: 59911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcacagatccgggctagacggggtaaac

SEQ ID NO: 59912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcacagcttacttttgtggttttcgtcg

SEQ ID NO: 59913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcacgctgtttatcgaaataggggactg

SEQ ID NO: 59914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcacgttcgtgtagtttggttggggcgg

SEQ ID NO: 59915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcacttgcccgcttcgggaaactgccgt

SEQ ID NO: 59916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcagcaggaggcggggaatccttcggtc

SEQ ID NO: 59917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcagccatgtttatggagcatacagctc

SEQ ID NO: 59918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcagcgttggtgcgcaccctacgggtcg

SEQ ID NO: 59919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcatcacagttggctagttttcgccggg

SEQ ID NO: 59920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagccagatatgtacgagtttggtgcgacg

SEQ ID NO: 59921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcccgtgagacttcctttcaactcgcgt

SEQ ID NO: 59922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcccgttcaagcccgttcccgcccaggc

SEQ ID NO: 59923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcctacaacgcttgctctgggacgggct

SEQ ID NO: 59924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcgagctcgggttagatccggtataggc

SEQ ID NO: 59925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagcggcccaatggctatcgagcgtagtag

SEQ ID NO: 59926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagctgctctactttgctatctattcagcg

SEQ ID NO: 59927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagctgtacggtgcgtctgtaccatgattg

SEQ ID NO: 59928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggaatagtacggaattgtacctacttaa

SEQ ID NO: 59929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggacgtttctttggaccatgttgactag

SEQ ID NO: 59930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggatttcagcggtaggggttgacgagtg

SEQ ID NO: 59931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggcaaacgggaacggcgggtcgtacttg

SEQ ID NO: 59932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggccaaggcgggaccgacaagtcaggca

SEQ ID NO: 59933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggcgtcgggcgaagaggtcgctgatctt

SEQ ID NO: 59934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggctgtcagagagtgcaatctgtccccc

SEQ ID NO: 59935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagggcgtaatcaacgtaggcaagatcgcg

SEQ ID NO: 59936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggggcatagatgtgagcagcacttgtgg

SEQ ID NO: 59937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggggggttcccagtgttggaccgacggg

SEQ ID NO: 59938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagggtctctcgtgtgttgcgaagaatcgc

SEQ ID NO: 59939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggtctccccacagtagcacattgatgtg

SEQ ID NO: 59940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggtctggccctttatcaagaccactctc

SEQ ID NO: 59941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagaggttggaggatagttatgcggcatgtcg

SEQ ID NO: 59942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagtaaaggacgttggcgaatcgtatgcaa

SEQ ID NO: 59943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagtatcactccgtagtattggtgttattt

SEQ ID NO: 59944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagtccatgctccattttgattccgctcgt

SEQ ID NO: 59945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagtcgcatcggtgtttgtattcatataat

SEQ ID NO: 59946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagtggacccaccctcgtcttgcgttgaat

SEQ ID NO: 59947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagtggttacggtttatttccaccgcgtcc

SEQ ID NO: 59948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagttagtcggccatattgaatcaggaggg

SEQ ID NO: 59949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagttcaacagatttgagcggagcgaaatg

SEQ ID NO: 59950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagttcccttgtaatgctctcgtgggtcaa

SEQ ID NO: 59951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagagttgaacgatgagataggttgtcaagta

SEQ ID NO: 59952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagataaagagatgtcattcgaggcaagttgc

SEQ ID NO: 59953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagataaagctaggttcgctgatcgggagggg

SEQ ID NO: 59954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagataagcacgaccccgatcctcgtgagtat

SEQ ID NO: 59955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagataagcctataatagctgtaaattccatt

SEQ ID NO: 59956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagataaggtttgggcttcaaaaatagtaagg

SEQ ID NO: 59957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatacccagcggtggataacttaaagatta

SEQ ID NO: 59958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatacctgttcgatacacaggtttggctag

SEQ ID NO: 59959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatactgtgctttacagtagtcggagtcta

SEQ ID NO: 59960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatacttgcgggcatagactgaccgagggt

SEQ ID NO: 59961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatagcagttaaggacaaacgggagcttgt

SEQ ID NO: 59962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagataggtaattctagatcatgcgcttattg

SEQ ID NO: 59963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatatcgattttcggtgtacgctatatcgg

SEQ ID NO: 59964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatccccttactggaggctgagtctaaacg

SEQ ID NO: 59965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatcctcgtcaacgcctaggtaccggtctc

SEQ ID NO: 59966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatcctggtatggcgtcaatcgctaatcaa

SEQ ID NO: 59967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatcgatgcgtacttgtgtcgcatgtgatg

SEQ ID NO: 59968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatcgccaggtaatggggaagtacttccgc

SEQ ID NO: 59969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatcgcggtcagctcgaaatatgcgcatga

SEQ ID NO: 59970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatcggatacacgaaactcgagagcgacgc

SEQ ID NO: 59971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatcggcggcaggcggaatcttgggtggat

SEQ ID NO: 59972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatgatactaatatcggtcggtcgtatcat

SEQ ID NO: 59973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatgatcctggacttgccgcgttgggtgga

SEQ ID NO: 59974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatgcatctctgaccgtgtaaaaaccagat

SEQ ID NO: 59975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatgcgtgactagcgtgtggcggtgcagtg

SEQ ID NO: 59976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatggatacggctgcattaaattactgtac

SEQ ID NO: 59977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatggcggtgggaggggcaagggtggtagt

SEQ ID NO: 59978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatggggtgggcccatacggtttattccgt

SEQ ID NO: 59979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagatgtgcttaaatatatggtcgtgcacgta

SEQ ID NO: 59980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagattaggtcatggctcggctcgcggcacac

SEQ ID NO: 59981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagattattcgccctactttgtctgccactgg

SEQ ID NO: 59982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagattctgcgcggcggcttaggtcatctaca

SEQ ID NO: 59983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagattgatttctggacttattctgttcgtgc

SEQ ID NO: 59984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagattggcataaatttccaaggatgagcagg

SEQ ID NO: 59985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagattgggctccgaggccggcaatagcgctg

SEQ ID NO: 59986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagattggtcttgaatattgatgttaatctga

SEQ ID NO: 59987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagattgtttgccttaatccagttcgggatga

SEQ ID NO: 59988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaaacattgaacctgtaccctaacacgcc

SEQ ID NO: 59989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaaacattgagggttgcttttgggtgccg

SEQ ID NO: 59990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaaagttttcgtaagtgacgcatgggtcc

SEQ ID NO: 59991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaaattcgaatttgcggcttgtccggtgg

SEQ ID NO: 59992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaacatgaaacaggcatcggctcgtgact

SEQ ID NO: 59993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaacggacttgaggagactacttataaag

SEQ ID NO: 59994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaagaacgggctgcaactttatgtttgag

SEQ ID NO: 59995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaagcaccgatagtctcgacgccggatgg

SEQ ID NO: 59996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaaggcgaatagtgctaagccgggatgat

SEQ ID NO: 59997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaatgagacgcttaccttcgtgcggccat

SEQ ID NO: 59998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacaagcaaattgaaccccatgcaagctg

SEQ ID NO: 59999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacaatgggactatattttcctatcggtc

SEQ ID NO: 60000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacaattaacaatgtctttgcacgggacc

SEQ ID NO: 60001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacaccgtaacttatgttcatcgtgcctg

SEQ ID NO: 60002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacacgcgctcggctcaatcttggatctc

SEQ ID NO: 60003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacacggcccgaagtacttttccaatctt

SEQ ID NO: 60004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacatctcaagaccactctgtgctgtaca

SEQ ID NO: 60005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacatgtggctttcggcacagtagcatgc

SEQ ID NO: 60006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaccagagcttccgtctggcctaccagcc

SEQ ID NO: 60007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacgccaaaccggtattggatgcctcttt

SEQ ID NO: 60008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacgcgaggcatgatgggcgccggtaaga

SEQ ID NO: 60009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacggggacgtactgtatgacctggttgg

SEQ ID NO: 60010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacggggtaagctcgcaaggatgtagtag

SEQ ID NO: 60011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcactaactcaaaagagtgacgccgtgcga

SEQ ID NO: 60012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcactacaccatccgaggacaatgacgctt

SEQ ID NO: 60013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcactagactcaatggcggctgtcgtttct

SEQ ID NO: 60014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcactccggttgagggcagtaagaagcacg

SEQ ID NO: 60015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcactctcgacagctcagcgattcggatgg

SEQ ID NO: 60016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcactggtgggcgaagtgttcatcgttggc

SEQ ID NO: 60017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcactgtcccccgtatgctcggtattgtgc

SEQ ID NO: 60018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcacttaacgtcaaaaacgacctgagatct

SEQ ID NO: 60019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcactttgggccattcctatatttcaagca

SEQ ID NO: 60020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcagaaggtggccctgttacttcgtacgtc

SEQ ID NO: 60021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcagacctcttgatccatgatactcccggg

SEQ ID NO: 60022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcagacttagtggcccgcttcgatcccccg

SEQ ID NO: 60023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcagatctgtatgcgaatggttcagaggta

SEQ ID NO: 60024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcagattggggcgggttcttctttgagccc

SEQ ID NO: 60025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcagcggccctcggtaaatctgtcgcgggt

SEQ ID NO: 60026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcagcgtatattacgtgctcaagttggtcc

SEQ ID NO: 60027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcagctttaacgggccgctcgtgaagtgta

SEQ ID NO: 60028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaggagacttccgtcgacagcggcaggtc

SEQ ID NO: 60029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaggcacgtgcctgacaaagctgttcgtc

SEQ ID NO: 60030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaggcagttcggattacatggtgtgaacg

SEQ ID NO: 60031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaggcgagcaagtaaataaagggcacgtc

SEQ ID NO: 60032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaggcgtccatggggtgaacacagggggc

SEQ ID NO: 60033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcagggcccccagccagcttctcgggttgc

SEQ ID NO: 60034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcaggtgttgggcctcgcgttttaaccacg

SEQ ID NO: 60035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcagtcacgctgcatgtcttccgattttcc

SEQ ID NO: 60036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcataagtgcatggtttagtccttcttgcc

SEQ ID NO: 60037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatagaggtttgcgggtaggggttgtagc

SEQ ID NO: 60038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatagttgtaataccacgatagggcgtct

SEQ ID NO: 60039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatatcatacagtggaccgaatgagacct

SEQ ID NO: 60040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatatttggtgcgcggtggacttacctga

SEQ ID NO: 60041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatattttcactagtctcatagtgtgcgg

SEQ ID NO: 60042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatcaaaaatcgtaattgttaggaccgtc

SEQ ID NO: 60043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatcacggtcctctcgtccacctctactt

SEQ ID NO: 60044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatcagagcggccctggatgactagtgtg

SEQ ID NO: 60045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatccacacagccaatggaggatgattgg

SEQ ID NO: 60046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatgacgcggatgagagcagctgggggtt

SEQ ID NO: 60047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatgacggacgagcatgttcacggtcagc

SEQ ID NO: 60048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatgccactagtaccttcctggaagctgt

SEQ ID NO: 60049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatgcgaacaaggatcgccgataggaggg

SEQ ID NO: 60050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatgctattaattgattactgaaatacaa

SEQ ID NO: 60051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatggggcgcgcagacgtcatttgagtgg

SEQ ID NO: 60052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcatgtgttaaatacatgttcggtcgcaac

SEQ ID NO: 60053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcattagaggaaatctaccacaatttgacg

SEQ ID NO: 60054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccaaacagctacttaccggagaaacaata

SEQ ID NO: 60055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccaaatgtcacggcggggaatcggaggcg

SEQ ID NO: 60056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccaattacacagtggggtcatatcatgtg

SEQ ID NO: 60057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccacaatctgtcatagggttttattcttt

SEQ ID NO: 60058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccacactagcaaaccatgcagtggtttac

SEQ ID NO: 60059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccacagctcgtgtgacgacgtgccgcata

SEQ ID NO: 60060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccaccggtgtctggagttttccagcctcg

SEQ ID NO: 60061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccacgactgcacacgcccatccaggatgt

SEQ ID NO: 60062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccacggtggttcttctcccctgtcaactt

SEQ ID NO: 60063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccagaggggtgtgacagtcctttggggcc

SEQ ID NO: 60064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccagagtaggcctgttccgttgctgtgtt

SEQ ID NO: 60065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccagccaactctttgctctccagtacgtg

SEQ ID NO: 60066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccagtggggataggggaatgggtcagctt

SEQ ID NO: 60067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccatgatcatgcggccgtggtcagttttg

SEQ ID NO: 60068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccatgcggagagtatatgccagatcactt

SEQ ID NO: 60069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcccaaaaccggcaataagcgctgcggtca

SEQ ID NO: 60070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcccatcggcgaggcgtgaggaggtaaggt

SEQ ID NO: 60071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcccatgtacgcagtgctgggctcgtgcct

SEQ ID NO: 60072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcccattatactcgaatcctgttgcacaga

SEQ ID NO: 60073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccccaacccggcagcgcgtgacaacaccg

SEQ ID NO: 60074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccccaggtcacgaagtccgtggattgtgc

SEQ ID NO: 60075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcccccagtattccgcggccccttgttatt

SEQ ID NO: 60076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccccggcgccaattcagcaagctcgcaag

SEQ ID NO: 60077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccccgggttattattcacggtgcctgggt

SEQ ID NO: 60078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcccctcgcggatcgatttagaggccaatc

SEQ ID NO: 60079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcccgacagagtagatccggactctggcaa

SEQ ID NO: 60080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcccgaggaggttaatcgagctatcaagac

SEQ ID NO: 60081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcccggcttaacgctgcttccttactttcg

SEQ ID NO: 60082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcccgggtaacacaattgtaccgcccccgg

SEQ ID NO: 60083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcccgtgactaagggcgtttagggaagagt

SEQ ID NO: 60084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccctcacttaggtccagagtccatttggt

SEQ ID NO: 60085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgaaaccccccttgcctctcgtggtttg

SEQ ID NO: 60086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgaacccctcggagacggacatgcagta

SEQ ID NO: 60087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgagcaggtgcgcgttagggcaacttta

SEQ ID NO: 60088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgattctccccgcatcatgggtgcaagt

SEQ ID NO: 60089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgcacgagtaaagtatagtgctaacgcg

SEQ ID NO: 60090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgcacgttccctgctcggacctacacgt

SEQ ID NO: 60091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgcgcgttcgatgagacgtgcacattcg

SEQ ID NO: 60092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgcgttaccttataggggccttgggatt

SEQ ID NO: 60093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccggaaacaagaatctgccacgcaatgcg

SEQ ID NO: 60094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccggaaggtgctgctgtagcctagtacca

SEQ ID NO: 60095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccggctacgaactgtctattgctgggctg

SEQ ID NO: 60096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccggttatgaaatgtaagcgagatcgtgc

SEQ ID NO: 60097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgtagtcccgatgggtctgagccggata

SEQ ID NO: 60098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgtcagctagatcttgatcttgtcgatc

SEQ ID NO: 60099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgtcgagcccttccccatcatgcctgat

SEQ ID NO: 60100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccgtttgccggaatctgacacgtgcttat

SEQ ID NO: 60101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcctaagaccgcaccagttcttgtttaccc

SEQ ID NO: 60102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcctattactgcgcgcggtttacctagtct

SEQ ID NO: 60103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcctatttggagtaaggtggccggtagcgc

SEQ ID NO: 60104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcctcaagtaagttgcatgactctttggga

SEQ ID NO: 60105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcctcagggcacgtgcaatccatggttcct

SEQ ID NO: 60106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcctccggaactggattgcaagccgctgtc

SEQ ID NO: 60107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcctcggattacgttagtgctttccttcgt

SEQ ID NO: 60108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcctgcaatgatttcacgcaattctaacta

SEQ ID NO: 60109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcctggttcgctcaacattgttaactccgg

SEQ ID NO: 60110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagccttatgcattagtgcaaccggtatggtc

SEQ ID NO: 60111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgaacacgtcctttagcgtgcgaagggga

SEQ ID NO: 60112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgaactccttggaggattatggtaagccg

SEQ ID NO: 60113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgaatgttcttacgacgttgtagtctggg

SEQ ID NO: 60114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgaccggcatgtgttgcaatgggttcgat

SEQ ID NO: 60115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgaccgttgttccaagaggttagtggccc

SEQ ID NO: 60116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgacctcgggtggcttaatgtctacccct

SEQ ID NO: 60117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgagacacatacgttgaccggtggtgtcc

SEQ ID NO: 60118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgagcgcgaaaagggaaggagacgtctca

SEQ ID NO: 60119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgagggatgtgccagagcaaggggcgatg

SEQ ID NO: 60120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgaggttgtacgatgttgcttgcattctg

SEQ ID NO: 60121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgagtgtgggttcggtctcggtagtttgg

SEQ ID NO: 60122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgatagctgcgtctgcgtacgtcctgttc

SEQ ID NO: 60123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgatctgatgtcttccgtgtgcggtcgcg

SEQ ID NO: 60124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgatgagaatttttactgtgtgagtggcg

SEQ ID NO: 60125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgatgtgcgagcgctacggccgagaacga

SEQ ID NO: 60126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgattccaagttaaaagaatgcacaagaa

SEQ ID NO: 60127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcaaacacttagaaaaccgatgtctctc

SEQ ID NO: 60128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcacagtatttggccggttactcacgtc

SEQ ID NO: 60129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcacccatcaacgattggtacagacgtg

SEQ ID NO: 60130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcacgtgattttgtctctcgtgtcgtct

SEQ ID NO: 60131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcagtgcgcagggctgctccgttgtcgc

SEQ ID NO: 60132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcattctgcttaatttgactggcgaagt

SEQ ID NO: 60133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgccaccgggcggcgggtttcatcagcaa

SEQ ID NO: 60134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcccatctgtaccgctcgtccccaaggt

SEQ ID NO: 60135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgccgaatgacttccacggggaccaccgt

SEQ ID NO: 60136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcgagtgctatcggcacctcaaaacccg

SEQ ID NO: 60137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcgggaggttgaacgggtggcttcctca

SEQ ID NO: 60138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcgtggcgattgcgtacgagcagtatct

SEQ ID NO: 60139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcgttcattttgccacacgagagacgtt

SEQ ID NO: 60140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgctccgggtctcccatgtcgttgtgctg

SEQ ID NO: 60141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgctcttgggttctgcacattgttgactg

SEQ ID NO: 60142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgcttgttacatacgcattagtttgctac

SEQ ID NO: 60143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggaccacggtagtctattgtgaagtcaa

SEQ ID NO: 60144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggacgacgttaccagtattctgcgtgcc

SEQ ID NO: 60145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggactaaccgaggaggggaaacagcttc

SEQ ID NO: 60146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggaggcaccgtattcgggttcgagacat

SEQ ID NO: 60147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggccggtgctgctttgctagttcttaac

SEQ ID NO: 60148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggccgttctgggaactcatcgcttgtac

SEQ ID NO: 60149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggcgcctcaacggtcaatgtgacgtccc

SEQ ID NO: 60150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgggaatgcaagtagtcgatggcccgtac

SEQ ID NO: 60151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgggacgtcaggcgaaggaacttctgcgg

SEQ ID NO: 60152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgggctaagtctggttgttacaacacgtg

SEQ ID NO: 60153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggggacaacctcgcagtgttttagggtt

SEQ ID NO: 60154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgggtgatctcgccttggttaatcgccct

SEQ ID NO: 60155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgggtgcgacgaccaaacgcatgatctat

SEQ ID NO: 60156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggtacgtcagttcagtggcctataactc

SEQ ID NO: 60157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggtaggctaatacgttcacgtgtcgcga

SEQ ID NO: 60158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggtcgttgggcgcatttggtcggctacg

SEQ ID NO: 60159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggtgataacggcttactgggtgtccccg

SEQ ID NO: 60160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcggttaatgaatcgcgacaatgttaaagc

SEQ ID NO: 60161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtaacccacccagcggaagggatcatcc

SEQ ID NO: 60162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtaatcaattttatatgatctggtaata

SEQ ID NO: 60163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtaccagacaagtagcgtgctttcgtag

SEQ ID NO: 60164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtagctcaaatcggactaaggtctacct

SEQ ID NO: 60165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtaggtatacttagttggctcggacttc

SEQ ID NO: 60166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtcaactgctctgtgaccatccgaagag

SEQ ID NO: 60167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtcattggctaattatctacatcgttca

SEQ ID NO: 60168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtccggcttaggcaatttactgtggtcc

SEQ ID NO: 60169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtcctgcgtgatgttcagtagttgagga

SEQ ID NO: 60170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtctatagggctcagtatgtgagcaatc

SEQ ID NO: 60171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtgactgtctgttgtgtgaggtgttggc

SEQ ID NO: 60172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtgatctggtgaatcggtctatctcgtc

SEQ ID NO: 60173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtgcagtagctaggcgttgatgcaagag

SEQ ID NO: 60174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtggctgtaaaccatgtaccgcggcagg

SEQ ID NO: 60175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtgggttaccggcccgatcgcaccgtgc

SEQ ID NO: 60176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgtgttcaaatccaggtgcttcacgttta

SEQ ID NO: 60177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgttccaactacacgggaccttaggccgt

SEQ ID NO: 60178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgttccggtggcttctatgttatcattgt

SEQ ID NO: 60179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgttcgtgaagtcgcagggtgaaaggtac

SEQ ID NO: 60180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgttggttttcgaccctttaacgggcatg

SEQ ID NO: 60181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcgttgtatagaggaaggaacttaccccgg

SEQ ID NO: 60182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctaagtgcctgagtcaagctagggaaccg

SEQ ID NO: 60183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctagattgaccagtgacatcaatcccggc

SEQ ID NO: 60184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctagcctaatgcatcatatattggactgc

SEQ ID NO: 60185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctagggagaggcaggtagcgaatttgctg

SEQ ID NO: 60186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctagggcaaacatagccatgtgggaagcg

SEQ ID NO: 60187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctaggtcttaatctccacgatctgcgcac

SEQ ID NO: 60188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctatacaagtagtcggtccaacacccacg

SEQ ID NO: 60189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctatcacgaggtgtgacttctagctattg

SEQ ID NO: 60190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctatcactcggctgtcacaatgcggcgtg

SEQ ID NO: 60191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctcaattcccgcccatgcgtgacacctcg

SEQ ID NO: 60192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctcaattgcgatttacgctcgacggtttt

SEQ ID NO: 60193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctcaccaatgcgaatcgacttcagcgggc

SEQ ID NO: 60194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctcacgacagtcggcggctggttggtcca

SEQ ID NO: 60195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctcacggttctcctcgctgcaagtttata

SEQ ID NO: 60196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctcagtggcccgggatccgtcctatagcg

SEQ ID NO: 60197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctcccaaggatcgcgcactttcacgtcca

SEQ ID NO: 60198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctccctcgtttcgtaaggacgttgtcttg

SEQ ID NO: 60199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctcctatcgcgagacacctcggcattgcg

SEQ ID NO: 60200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctcgcaaatcttctccggtcatcacagtc

SEQ ID NO: 60201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctcggccttcgctgcctaaggcggggctt

SEQ ID NO: 60202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctctacggtgcttgtttctcgacagattg

SEQ ID NO: 60203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctctaggaccgagctaagtccttattcgc

SEQ ID NO: 60204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctctgagttacgcgcatcgagtaggttcg

SEQ ID NO: 60205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgagaggtcttagggacgcgcaaatcgg

SEQ ID NO: 60206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgagcctaaaaccttggggttagtgcta

SEQ ID NO: 60207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgaggtggctgaagcagggcggtgtcta

SEQ ID NO: 60208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgcaaccgagtacgttttgagcgtctgg

SEQ ID NO: 60209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgcagtaccccggcgctattgactcccg

SEQ ID NO: 60210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgcccgtcacaaacaaagaggcgctaga

SEQ ID NO: 60211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgccgaacaggggtagagatctgcgcgc

SEQ ID NO: 60212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgcgatagcttctgtacatacccttccg

SEQ ID NO: 60213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgcggatggggaccttaacctgaaggca

SEQ ID NO: 60214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgctgattagtcacctgttcgctgtgtc

SEQ ID NO: 60215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgcttgggcttggtctggtgcgcaagag

SEQ ID NO: 60216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgggcccttccgggtaggtttcacctcg

SEQ ID NO: 60217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctggttggtctaggaggtgggtataaatg

SEQ ID NO: 60218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgtacgccgcgtcgtgcccgtgccggcc

SEQ ID NO: 60219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgtatgctttgttggatggcggcgttta

SEQ ID NO: 60220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgtcagcacaagtgatcatatgtgaagg

SEQ ID NO: 60221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgtcaggcgaatccggtcagtgtgcatg

SEQ ID NO: 60222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgttcaggactactggtggttcggggcc

SEQ ID NO: 60223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagctgttctgcgttttatttcactcaccctt

SEQ ID NO: 60224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttaaaagctgtgtagatttacttaccct

SEQ ID NO: 60225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttaaccgttcgctattgcgtttgtgcgt

SEQ ID NO: 60226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttactcgagaagccgtcatccgtgctgt

SEQ ID NO: 60227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttacttgctgtttttggtatgttccctg

SEQ ID NO: 60228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttattacgtcacgggttgtgtgcgcttc

SEQ ID NO: 60229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttcaagtgatagaatgacggtatggtgg

SEQ ID NO: 60230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttcaccctcctgctggatcaattccctt

SEQ ID NO: 60231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttcgattgcttgacgtcttacatcagca

SEQ ID NO: 60232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttctccggcctactttgcgaccgagcgc

SEQ ID NO: 60233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttctgggatacactttgtttgggcagcg

SEQ ID NO: 60234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttgcagcaccgctaaatactcacaactt

SEQ ID NO: 60235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttgggtgtcagggtacgagtccgacgcc

SEQ ID NO: 60236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagcttgggttcatgatttcaggtattcggcc

SEQ ID NO: 60237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaaactacgtagcgcggcgacggctttgg

SEQ ID NO: 60238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaaagccgtgtgtgtctgtggctccgcgg

SEQ ID NO: 60239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaaagggtggtcattgatgggtaccaaag

SEQ ID NO: 60240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaaatgagataccatctgccagctcactg

SEQ ID NO: 60241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaacagttatttaacgtgaatcgctgacc

SEQ ID NO: 60242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaacgcagctaggggtggattgtgcatgt

SEQ ID NO: 60243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaagaatgggcaatgcaaatagggcgccg

SEQ ID NO: 60244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaagttgggtgcactgttggttcatcccg

SEQ ID NO: 60245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaatccggttgctcggctatgcatttcgg

SEQ ID NO: 60246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggacaacacatctgcacagccgtggtcgca

SEQ ID NO: 60247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggacaatgataaggcgattggtggcgtggt

SEQ ID NO: 60248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggacacagcgtagataatgggttggttagg

SEQ ID NO: 60249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggacaggaagctcagttaaaagcactggag

SEQ ID NO: 60250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggacattatgataccacgacgtcgaggtta

SEQ ID NO: 60251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaccagattgtgctaagacttttgcggta

SEQ ID NO: 60252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaccagtcttgtgtgtgtcgcgcactggg

SEQ ID NO: 60253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaccgcgacagagacacgtaacggatcct

SEQ ID NO: 60254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaccgtgccttgaggtcatggttgtgctc

SEQ ID NO: 60255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggacgaaggtcagttggtggagctgggggc

SEQ ID NO: 60256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggacggaggtggaccacatggcggggctag

SEQ ID NO: 60257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggacgtaaccttaagattcttcggcggtgg

SEQ ID NO: 60258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggactatgcccggcttcgtccgcgtctggt

SEQ ID NO: 60259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggactcggaaagggtggcggggtaacaagg

SEQ ID NO: 60260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggactcggatcgaaccgcgctggttcaacg

SEQ ID NO: 60261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggacttacgcccctcgtccgtttctcggcg

SEQ ID NO: 60262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggactttgccggtgaaccgttctgtggtag

SEQ ID NO: 60263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggagaaggctttaccaacattcttgctgtt

SEQ ID NO: 60264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggagaccagactctgcggtggcgctggctg

SEQ ID NO: 60265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggagagccctgagcaccgacgtcgaagggt

SEQ ID NO: 60266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggagattgtgcggttctcccgacaagcctg

SEQ ID NO: 60267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggagctcaattgtcttacaaattaccggtc

SEQ ID NO: 60268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaggaataaatcgcggagaagagcgcatc

SEQ ID NO: 60269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaggatccagattatgcgtatggctgcta

SEQ ID NO: 60270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaggcgactcttaagcgggtgggtcatta

SEQ ID NO: 60271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaggggaacctgcccggggggtgatctcc

SEQ ID NO: 60272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaggggctaaataggacccacgggaaggg

SEQ ID NO: 60273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggaggtcaggtgtcatagtaggttgtgcac

SEQ ID NO: 60274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggagtaagtaccgctactaatcgccgggtc

SEQ ID NO: 60275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggagtggggtcgtgaagttgtgatttcagt

SEQ ID NO: 60276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggagttaacaatctccagaggtttcattta

SEQ ID NO: 60277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggagttgtcctcgcctgacggacgccacgg

SEQ ID NO: 60278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatcactagccaagcaaatgatatcgtgt

SEQ ID NO: 60279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatcactggcactctctataatggtgtta

SEQ ID NO: 60280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatcgctcgtaactgtgttcctctggtca

SEQ ID NO: 60281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatctcggtgaagcctatgcgcatagttg

SEQ ID NO: 60282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatctcgtgtaccctcaacggtagagcgt

SEQ ID NO: 60283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatctgctcgtttacaaaggcatagaaac

SEQ ID NO: 60284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatgaaggaccatacacccatgcgctgta

SEQ ID NO: 60285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatgagggactaaatacctagcttaggcg

SEQ ID NO: 60286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatgggatggggcgcacgaagacctgagg

SEQ ID NO: 60287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatggtgcggattgcgcatggggagacca

SEQ ID NO: 60288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatgttatttcagagaaggccttttacgg

SEQ ID NO: 60289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatgttccgtagctcaattcttaggttct

SEQ ID NO: 60290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggatgtttagctcataccggattatttaaa

SEQ ID NO: 60291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggattacataacgtcagacactcgcttaga

SEQ ID NO: 60292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggattatcatcggcgtcgcacgcattggtc

SEQ ID NO: 60293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggattctacattaaggcaaggtgggtaaaa

SEQ ID NO: 60294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggattggtgtggtggtcaatgcccggatct

SEQ ID NO: 60295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcaaagttcgggccatggtctaccccgtt

SEQ ID NO: 60296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcaacggcaatgttctcttgcgaattctc

SEQ ID NO: 60297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcaacggtttatttgaggcacccccatct

SEQ ID NO: 60298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcaacgtcgtgctgattatggcgccattc

SEQ ID NO: 60299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcaagcgatatgtccgatcaatcttgcgg

SEQ ID NO: 60300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcaattcttaataacggccactgtgatat

SEQ ID NO: 60301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcacaccggctcagatcgtcacacatctc

SEQ ID NO: 60302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcacacgcctcatgctctcgttcagcctt

SEQ ID NO: 60303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcacattcgacttcatcgtcgttgaatcg

SEQ ID NO: 60304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcaggctcgggctcccccgagtcatctat

SEQ ID NO: 60305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcagtggggaacgggctcctgcggatgtt

SEQ ID NO: 60306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcataccgttggaccaatgaaggggaacg

SEQ ID NO: 60307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcatcttcaacattgatcgcttgatgagg

SEQ ID NO: 60308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcatcttcgtcacttaatggccgcgaata

SEQ ID NO: 60309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcattaggaatgtgaccgtgtccgctgca

SEQ ID NO: 60310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccaaccatttatagttgtcgtatctaga

SEQ ID NO: 60311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccaatgaataccgcgtagaggacggact

SEQ ID NO: 60312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccacgtgttgggacggcatcacaagtat

SEQ ID NO: 60313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccagacgggttggatgcgtacaggaccg

SEQ ID NO: 60314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccagcagaaggcgcacagtggcgtaaat

SEQ ID NO: 60315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccatgaggtatccgttgtagggtcgact

SEQ ID NO: 60316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccatgcgagtgattcatgtctggtcatt

SEQ ID NO: 60317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccccaaaggacgactcccagttctgtcg

SEQ ID NO: 60318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccccaacattactggcagcggcatcaat

SEQ ID NO: 60319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccccgtcttaatggatatgtcttgcgcg

SEQ ID NO: 60320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcccctcgtagtcgcatggcatactgctg

SEQ ID NO: 60321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcccggcggagatctgtttaagactttac

SEQ ID NO: 60322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccctccaaggaattatcgtgcatgcacg

SEQ ID NO: 60323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccctgatagtgctggtctaatgtggctg

SEQ ID NO: 60324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcccttaggaacgctgtgtaatgacttgc

SEQ ID NO: 60325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccgactactttggggtgacttgggttgg

SEQ ID NO: 60326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccgatccataggtgacgaataacccatg

SEQ ID NO: 60327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccgattgcaacttcggttaatcgcggat

SEQ ID NO: 60328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccgccaatggtgttgtcatcgcggactt

SEQ ID NO: 60329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccgggatctcgctatcgtctgggtagtg

SEQ ID NO: 60330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggccgtctattcctacgtaaagcgtcgata

SEQ ID NO: 60331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcctaacagtatgtcgtgcgccatgagag

SEQ ID NO: 60332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcctatgacaagcggctctgtagttggcg

SEQ ID NO: 60333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcctcgatccgttatctcagggtgttcaa

SEQ ID NO: 60334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcctggccctcctgctcacgtactctcta

SEQ ID NO: 60335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcctttgctttgttcgtatacagctcagt

SEQ ID NO: 60336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgaagttcctatagtaggtattgtgtgg

SEQ ID NO: 60337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgacacgcttttaaccatcattccaaga

SEQ ID NO: 60338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgaggcttcctagatctatttacacgcc

SEQ ID NO: 60339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgatagaatttcccgcgcgagttctggg

SEQ ID NO: 60340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgcatttggaacagttcccgcaattcac

SEQ ID NO: 60341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgcgagtggagtaggggggagagtcccc

SEQ ID NO: 60342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgcggctctgctcagtaaactggggacc

SEQ ID NO: 60343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgcgggcaccgtctccggcatgcgatcc

SEQ ID NO: 60344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgctacaacccaatgtttcgggatgccg

SEQ ID NO: 60345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgcttttggggggtgtactgcttgcctt

SEQ ID NO: 60346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcggcacggtgcatcgagtcaggaaccgc

SEQ ID NO: 60347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcggcaggtatgttggatcgtgcctatat

SEQ ID NO: 60348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcggctgacggtgtgcagtcgaccgatgt

SEQ ID NO: 60349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgtagatgcatttgatccgtatgttact

SEQ ID NO: 60350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgtgtgctcggtgtgatattcgattgag

SEQ ID NO: 60351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcgtgtgtaggttagctcgtgatggtcgt

SEQ ID NO: 60352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctaatacttagtattactccggagcttt

SEQ ID NO: 60353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctaatatacgtatcaggttttagggttt

SEQ ID NO: 60354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctccctcaactgttggtaagttgctcga

SEQ ID NO: 60355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctctcaaggttttccatcctgttttgtc

SEQ ID NO: 60356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctctgtgttaagctcgagggttttggag

SEQ ID NO: 60357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctgctacgtcggattggatgctgcggtc

SEQ ID NO: 60358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctgctttacaactactttggagcgcgca

SEQ ID NO: 60359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctggatacattggcctatggcatggtca

SEQ ID NO: 60360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctgggtgaatccttgaaccacaacaacg

SEQ ID NO: 60361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcttaaaactggcgtgttagacatttact

SEQ ID NO: 60362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggcttgttgcatcgtgcagctcggatgtat

SEQ ID NO: 60363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctttaaccattcttgcctgggtcatagc

SEQ ID NO: 60364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctttcgtgttgaggaataggaccgtgct

SEQ ID NO: 60365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggctttgacccgaggattaaggctctttca

SEQ ID NO: 60366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggaaacgtacaaaggtcctgcgtctgggc

SEQ ID NO: 60367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggaaccattgactcagggaaattcgtttg

SEQ ID NO: 60368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggaagcacgtgaacgttcgccctgatcca

SEQ ID NO: 60369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggaccagtgggttgtggtcgaattgcttc

SEQ ID NO: 60370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggactcgggtttagattagcctgcattat

SEQ ID NO: 60371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggactggcgtaaacctcaaatgctcctgc

SEQ ID NO: 60372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggactggtcgggtagttggatggactccc

SEQ ID NO: 60373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggacttgtatacctgagggtatggcgacg

SEQ ID NO: 60374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggagaaatgcatttcctgttcggtgtttc

SEQ ID NO: 60375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggagcatgataatccaagtcaaggtcgtc

SEQ ID NO: 60376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggaggcggtcatgctactcgcggtgtgcg

SEQ ID NO: 60377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggagtattgaaagccagggtcgtgctaag

SEQ ID NO: 60378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggatgatttaaaatccatggcgacttgct

SEQ ID NO: 60379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggatgcatatttatttcatctacggatgg

SEQ ID NO: 60380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggatgtggtaaccgacgtgagtgcgcggg

SEQ ID NO: 60381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcaaatgtggctgtttcgaggttgggcg

SEQ ID NO: 60382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcaccaaaacctttgattgcgtatatct

SEQ ID NO: 60383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcactataagtggcccggcgcagtgtca

SEQ ID NO: 60384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcagatacattctataagcaagctcggt

SEQ ID NO: 60385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcaggggggtgctggcggctcttgcttg

SEQ ID NO: 60386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcagtacagggaccgcttcattataggt

SEQ ID NO: 60387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcattatgtccattttgcctgcgccttt

SEQ ID NO: 60388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggccgtgttaagcgacaacgccacagtgt

SEQ ID NO: 60389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgaaataagcgggaaatcgccgactgg

SEQ ID NO: 60390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgaaggtcaggctttgattacgggcgc

SEQ ID NO: 60391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgatgtatccgtgtggtacctgctgta

SEQ ID NO: 60392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgattacggaagcaacgtttaaccatt

SEQ ID NO: 60393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgcaaagcccggaggccactcgacgtt

SEQ ID NO: 60394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcggataaagaggccagcgaggttccgg

SEQ ID NO: 60395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcggctgccacggatcacaagtcgaagg

SEQ ID NO: 60396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgggcaaacagtctgtcagacgagggt

SEQ ID NO: 60397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgggtagatagctggcaatgctgcggc

SEQ ID NO: 60398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcggtacaccttcactcggggctgtcac

SEQ ID NO: 60399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcggtgagggggtgttgacgatcgacaa

SEQ ID NO: 60400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgtaacagcatgtactttggagcatta

SEQ ID NO: 60401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgtaattcgcgaagcatatgctacggt

SEQ ID NO: 60402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgtctgtgtaagcaaagcatcacgtgc

SEQ ID NO: 60403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgtggggcgtacacgctacagctgcgg

SEQ ID NO: 60404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgttacagtcaacgagcaaggagtgtt

SEQ ID NO: 60405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggcgtttacaatcatcgtcttagtagagc

SEQ ID NO: 60406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggctaagatgcttgaagccatcgatcgcc

SEQ ID NO: 60407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggctcctacggcgactcatttgttcggcg

SEQ ID NO: 60408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggctcgagcagacatgtggccgtgatggt

SEQ ID NO: 60409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggctggcccgccgatgcggtggtctagtg

SEQ ID NO: 60410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggctgtagtaagtctagagcagactcggt

SEQ ID NO: 60411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggaacacggcttagaagaaccctgcggg

SEQ ID NO: 60412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggacgaaataaccgaagacgacgtgaag

SEQ ID NO: 60413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggaggtctgaagcggttcaacagcgctt

SEQ ID NO: 60414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggagtgcttacatgtctttgcacttcac

SEQ ID NO: 60415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggcaagcaccagtttaactaatctgagc

SEQ ID NO: 60416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggccgagaccgtgaaccccggcacgcct

SEQ ID NO: 60417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggcgaccaattgtgttggcacgcggcac

SEQ ID NO: 60418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggcgactcaaggtgtcctcaactgaccg

SEQ ID NO: 60419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggcggttaactctgctagtctacacaac

SEQ ID NO: 60420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggctattgaggctacaactcgacacgtt

SEQ ID NO: 60421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggggcacgaggtccgttctgctcgtgggc

SEQ ID NO: 60422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggggccgcagggccttgggtgctcggagc

SEQ ID NO: 60423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggggcttttcagatttgaccttccggggg

SEQ ID NO: 60424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggggtctgattagaggttgtgccgtgccg

SEQ ID NO: 60425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggtccggcatcggccttatgcgcaggta

SEQ ID NO: 60426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggggtggattttgtcactcttgctcccttg

SEQ ID NO: 60427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtaacagagataggaatcgtgaggccac

SEQ ID NO: 60428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtaaggcctgcgtgggtccactgtgggc

SEQ ID NO: 60429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtatgttactccctttgtcaagcagcct

SEQ ID NO: 60430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtcaagtacgcagctgtgaattcacgct

SEQ ID NO: 60431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtcactagggtcgtttagcgaggcacct

SEQ ID NO: 60432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtcgggctcggagcggtgacccgatgcg

SEQ ID NO: 60433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtctgccccgggtattacgtagctgctg

SEQ ID NO: 60434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtgacctttgtcgctatcttgaatttta

SEQ ID NO: 60435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtgcatgctgtatctgatattagactcg

SEQ ID NO: 60436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtgcgctatgctctcatatgacgtgggg

SEQ ID NO: 60437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtggcctcttctgaccattgaaaggttg

SEQ ID NO: 60438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagggtggtcatcacgcttcgacgccagagtg

SEQ ID NO: 60439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtaagtgcggagaaccacgttccggcgac

SEQ ID NO: 60440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtaagtttctggggaaggtcgacttcaca

SEQ ID NO: 60441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtaatgatgatcctcgagacatctcaagc

SEQ ID NO: 60442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtaattattcgtgcttcgtgccataggct

SEQ ID NO: 60443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtacatttacaaaccgtgtcatattaatt

SEQ ID NO: 60444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtacggaccggttttctttggggctagac

SEQ ID NO: 60445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtacggagccgggcatatataaccattgg

SEQ ID NO: 60446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtacgggtaccaccacgccacaattcttt

SEQ ID NO: 60447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtacgtgcggagcacgtttgtatgctaga

SEQ ID NO: 60448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtagtggtgacggcctgggctaaatcact

SEQ ID NO: 60449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtatactgccgggcgctaccggaacgaca

SEQ ID NO: 60450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtattaatccgcgacgtcttactaaatga

SEQ ID NO: 60451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtattgacgtggggtcacgtatgttcaca

SEQ ID NO: 60452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtattgtgtctaatcgtgcggacatttga

SEQ ID NO: 60453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtcacgtcagttcgcttttaagtacagga

SEQ ID NO: 60454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtcacgtggaacccgctgctcgaagttgt

SEQ ID NO: 60455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtcactgggggacaatcgacatttactgg

SEQ ID NO: 60456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtcacttgggtaggtaacttctgtacgga

SEQ ID NO: 60457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtcatagatgcgatagacacggctggtca

SEQ ID NO: 60458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtcatcgttgtgcataggtgtgggaagtg

SEQ ID NO: 60459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtccccgactcatgttgcaagtctccctt

SEQ ID NO: 60460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtccgggcaaaggtatctcgacaatttat

SEQ ID NO: 60461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtccgtggctctgagatgtatgtggtggc

SEQ ID NO: 60462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtcgtcatgagtggcgggctagcggtcga

SEQ ID NO: 60463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtctgcacctggtccaaccagactcggtt

SEQ ID NO: 60464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtctttaatcacattaacgaactcttagc

SEQ ID NO: 60465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgaacacctatttctatctattgcggcc

SEQ ID NO: 60466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgaacacgacctcacgtgcagggacggt

SEQ ID NO: 60467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgaatttcgcggcgcggtagtgtcgggt

SEQ ID NO: 60468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgatctgctagcccatgttctgatgcgt

SEQ ID NO: 60469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgcacgagttccgagttcgatgctagtc

SEQ ID NO: 60470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgcagtgctcctagggatcgattccgtg

SEQ ID NO: 60471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgcgaagagcgcgtttatcgcgattctt

SEQ ID NO: 60472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgctacgataggtaagtgtgtggactgt

SEQ ID NO: 60473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgctatatatttactcgtttgggacttg

SEQ ID NO: 60474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtggaggtacactcctcggcccgaatgtc

SEQ ID NO: 60475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtggcacgatttatattggtttccattaa

SEQ ID NO: 60476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgggctcttttgtcctctgtagctaatg

SEQ ID NO: 60477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtggggtgttgcgaaaaaagcttggtagg

SEQ ID NO: 60478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgggtacgcattttttcacgaagcgctt

SEQ ID NO: 60479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgtactatttactgatccttgacaccgg

SEQ ID NO: 60480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgtcagtcgcttcctccttccgctgata

SEQ ID NO: 60481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgtgacagcaggtgggttattatggaac

SEQ ID NO: 60482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgtgtattaacccctggcttgatgatac

SEQ ID NO: 60483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgttagcgccgaccatctcgtgcttagc

SEQ ID NO: 60484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgttcgaacttatacatttagtcttata

SEQ ID NO: 60485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgttcggcagccaggtaattcggtatta

SEQ ID NO: 60486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtgttttcacacatgtagagttcacgtcc

SEQ ID NO: 60487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttaaacgatgggctacgcgtcgggtggt

SEQ ID NO: 60488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttaacagagtggccgtgaccagtacacg

SEQ ID NO: 60489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttaagtgtatcgtcacataggatggtga

SEQ ID NO: 60490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttacggccgtagaggacaactgccgggc

SEQ ID NO: 60491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttactagagagcttttgctgtcgggtcg

SEQ ID NO: 60492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttatgcataacgtgaacatgcgttatca

SEQ ID NO: 60493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttcaggacaccatgtatcgatatgggga

SEQ ID NO: 60494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttccccgaggatttcggccctgagtacc

SEQ ID NO: 60495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttcccgtctacgggggccgttcggcgtc

SEQ ID NO: 60496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttgagataagtacgatcgtcaaactgtg

SEQ ID NO: 60497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttggcgcgtttgacacgacgtaggttcg

SEQ ID NO: 60498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttggggttagaatcctgcccgaaccggt

SEQ ID NO: 60499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttgggtcggccattgcttcatccccgtt

SEQ ID NO: 60500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttgggtctgtcggaatgaggatgacctg

SEQ ID NO: 60501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttgttcctgagccgcgtgggtaagccgg

SEQ ID NO: 60502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttgttcggccatttatgcgtgtctggct

SEQ ID NO: 60503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggttttagcgaccgtattctttaaatgcgc

SEQ ID NO: 60504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
taggtttttatgtcattgcgttgcggccgcac

SEQ ID NO: 60505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtaaacggcacgatagcttttttagcatag

SEQ ID NO: 60506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtaacagggcgccaaatgatcacattgctc

SEQ ID NO: 60507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtaacttgcagaaccggggtcattgggacg

SEQ ID NO: 60508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtaagcatcgcagtagtatcagccccgaca

SEQ ID NO: 60509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtaagggcacgagtagctcgaaccgattgc

SEQ ID NO: 60510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtaagtctccgactgagcaggagaattggc

SEQ ID NO: 60511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtaatcagttcattatatgataatcatagc

SEQ ID NO: 60512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtaatgctagtgcttatagtccacgccgca

SEQ ID NO: 60513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtacagggggcctgatcgttgggcttcaag

SEQ ID NO: 60514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtacatttcaagttcaggggctccctaccc

SEQ ID NO: 60515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtacccctgcacggagccccggtctagagc

SEQ ID NO: 60516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtacccgttctgtggccagaaggatggatt

SEQ ID NO: 60517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtacgaggataatttctgcgtcactccctc

SEQ ID NO: 60518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtacgtggaagggacggggattcacgagtg

SEQ ID NO: 60519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtactcagccgccgacttgtcaataaccgc

SEQ ID NO: 60520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtactcctcgctaggcctggcggtggtatg

SEQ ID NO: 60521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtactttccatcataggtcccgccactctc

SEQ ID NO: 60522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtagagatatcgcacgtttcggccgtttga

SEQ ID NO: 60523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtagcaagcagttgtcgttcatacgcgggc

SEQ ID NO: 60524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtagcacagtactctggccgtgcgcgtatt

SEQ ID NO: 60525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtagcacatgacggcgaatggcggaacggc

SEQ ID NO: 60526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtagccgtgcagacatagcaggcctcgctg

SEQ ID NO: 60527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtagcggaccctgtcgtctagacggtgttt

SEQ ID NO: 60528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtaggaccagggactcttctctgggttcgg

SEQ ID NO: 60529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtaggccatctacacatacccccgctgtca

SEQ ID NO: 60530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtaggcgtagaagttattcttcgaagagcg

SEQ ID NO: 60531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtagggggttagcagtacagcatattccgt

SEQ ID NO: 60532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtagtcggtgcgtttgatcggtctataacc

SEQ ID NO: 60533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtagttaactgaccccgcaacagcgctcgg

SEQ ID NO: 60534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtataacggcatatagttaaatcacaggag

SEQ ID NO: 60535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtatatggcgtcatatcacaagggcccagg

SEQ ID NO: 60536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtatcacggtccggtcgctgacatcctgct

SEQ ID NO: 60537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtatccgccgcgaatcgactccgtagcacc

SEQ ID NO: 60538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtatccgcggcacgtcctacagtgcgggtg

SEQ ID NO: 60539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtatccggagtgcgctaaagtcggaagatg

SEQ ID NO: 60540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtatggcgcttacggtcgaggcattaccca

SEQ ID NO: 60541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtattctactttctcgtaaagttgcacata

SEQ ID NO: 60542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtattgtccgcgcccatcgtcttaaataag

SEQ ID NO: 60543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtattttacaagaattaacctatcggcgtg

SEQ ID NO: 60544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcaaaagaggttgacgaagcgctgaatcg

SEQ ID NO: 60545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcaacgcccttgagttcttatcgtgaacg

SEQ ID NO: 60546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcaaggtctggatacgccattatcggggg

SEQ ID NO: 60547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcacagtctgagattggtatccatgtttt

SEQ ID NO: 60548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcacgacaggacgtatcaggaaatcctgc

SEQ ID NO: 60549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcactacacttgcatgtactcagcgcctt

SEQ ID NO: 60550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcagccctcggatgatactcgcggcttac

SEQ ID NO: 60551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcagggtaagcgcgcgcaatgcaaaaacg

SEQ ID NO: 60552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcaggtgttggtctggggctggctctgtg

SEQ ID NO: 60553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcatatcagataccggtagggcttaccgc

SEQ ID NO: 60554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcatcctacgtggccagttggatgggagg

SEQ ID NO: 60555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcatcttggtgctggcttcaacatgtaca

SEQ ID NO: 60556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtccaaagcataagtagctctcaacggctg

SEQ ID NO: 60557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtccagcatccagttctgtggtccgcatat

SEQ ID NO: 60558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtccatctctgcaacacctcgcttggtcca

SEQ ID NO: 60559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcccgcactttggtcagaggtcacgcgcc

SEQ ID NO: 60560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtccgactctatggcgcccgattgctcccg

SEQ ID NO: 60561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtccgagcctcgaatggagcacagaacgag

SEQ ID NO: 60562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtccgcaggatggcccccactcacgcccgg

SEQ ID NO: 60563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtccggatgatgcttccgatgttttctgct

SEQ ID NO: 60564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtccggcgttagattgaccagagttgcgtt

SEQ ID NO: 60565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtccggcttggcaacagactgggacagatg

SEQ ID NO: 60566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcctagctgcggcttgcgtgtcaactgtc

SEQ ID NO: 60567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcctgcccgaatcggttgctaacaactgt

SEQ ID NO: 60568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcctgttcttttatgaagaatggaaattt

SEQ ID NO: 60569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcgaacaaatccatatagtacgaggtgga

SEQ ID NO: 60570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcgaacgaaaaaatctccggtttggcctc

SEQ ID NO: 60571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcgcaactcgtttccatgccctttaggct

SEQ ID NO: 60572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcgcgcttaggtggccattggggaagaag

SEQ ID NO: 60573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcgcgtctgcaaagattagtgcggaccgt

SEQ ID NO: 60574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcgctactaggctccgtatggttccgtgt

SEQ ID NO: 60575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcgctgcgtcgcggtgctcgccgtcctgg

SEQ ID NO: 60576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcggcaatggtgattcctagggagccgtg

SEQ ID NO: 60577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcggccgggtaaaacgcaattgcagacgc

SEQ ID NO: 60578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcgtcccgggagacgaggtgactgtgggg

SEQ ID NO: 60579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtctacaactcccgacggtgcactccttgt

SEQ ID NO: 60580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtctcccatgatgcggtttttcaaggccga

SEQ ID NO: 60581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtctcccgtgtgcaatacttatgctgattt

SEQ ID NO: 60582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtctcgtggaagtagcatgcttctcgcacc

SEQ ID NO: 60583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtctctttttatgtggcggtgtgggtatcc

SEQ ID NO: 60584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtctgcagtgcccctgtgatgtcaaagatc

SEQ ID NO: 60585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtctgcgcttcccatatgtagtggcgggct

SEQ ID NO: 60586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtctgtcttgatccagagcggaatacgttg

SEQ ID NO: 60587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtctgttgagtgcaccgcgatatatccatt

SEQ ID NO: 60588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcttagaatattcgccgctggtgggtacg

SEQ ID NO: 60589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtcttggcgttaccatcggacggggctact

SEQ ID NO: 60590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgaaccggctcgggtaagtctagctctgg

SEQ ID NO: 60591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgaagcctttttcggctgcaagtgtggtt

SEQ ID NO: 60592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgaattccgttttattaccagagtctgtc

SEQ ID NO: 60593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgaattcggagaccattgtgcctgctctt

SEQ ID NO: 60594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgaccgggcttagtaggaataacttttca

SEQ ID NO: 60595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgagcgggggatcacagtcagttaaagtc

SEQ ID NO: 60596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgcactattttgtccttctgttatagagt

SEQ ID NO: 60597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgcatgagagcttaattcgaggtacagtc

SEQ ID NO: 60598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgcatttttgggattttttcgaggaatct

SEQ ID NO: 60599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgccagcgatggtgtcaacagcctcaccg

SEQ ID NO: 60600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgccgtcggagggcgtcgatttaaattct

SEQ ID NO: 60601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgccgtgattctcgctcgactgtttagca

SEQ ID NO: 60602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgctatctcccggtgcgaggcgtatcagc

SEQ ID NO: 60603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgctcggtggtgatagtcctctcgcttat

SEQ ID NO: 60604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgctgcgaacgaccggcatgcgggcaata

SEQ ID NO: 60605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgctggggtcaagggatagcttgtgatgt

SEQ ID NO: 60606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgcttccagggatacttacagagagcaat

SEQ ID NO: 60607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgctttacgaggttttaaaacagtgtatg

SEQ ID NO: 60608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtggacacgggtctccacggttttagctta

SEQ ID NO: 60609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtggacggtccaaagactaagtgcttccat

SEQ ID NO: 60610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtggccctcggagctcttgtctttctttcc

SEQ ID NO: 60611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtggcgttatcgatgagggcttgaagaggg

SEQ ID NO: 60612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgggagttcggtgacacataatgccgttc

SEQ ID NO: 60613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgggcactaggacgcacagtttccgcttc

SEQ ID NO: 60614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtggggggcgccgggaccgaccgggaccgt

SEQ ID NO: 60615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgggggtctccgggttcgcgttagactgg

SEQ ID NO: 60616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgggtgttgccgaaggggtccgtgcaggc

SEQ ID NO: 60617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgggtttgtcccccgtagccctgcgcgac

SEQ ID NO: 60618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgtaacatcatgtctcgtagtggatgata

SEQ ID NO: 60619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgtactgatcggcgggcagtaagacatga

SEQ ID NO: 60620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgtcaatgacacggtttgtcggtatccaa

SEQ ID NO: 60621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgtccacattatttcaccgactgtcatac

SEQ ID NO: 60622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgtgcgatgaactttattcatatggccgg

SEQ ID NO: 60623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgtgcttcctcacatccgatgtgatggcc

SEQ ID NO: 60624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgtggtctgggtgggttaaacggtgatac

SEQ ID NO: 60625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtgtgtgtaccctctggtaagaaacccttt

SEQ ID NO: 60626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttaacccgaatgtgttgttggcgaccatc

SEQ ID NO: 60627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttacacagtctgatatactggtgcgtctg

SEQ ID NO: 60628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttacgccgcttttgttcatctgtggagca

SEQ ID NO: 60629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttacgcgtgagttaacttgatgctcttcg

SEQ ID NO: 60630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttacggtcggccaataccagcgtcgacgc

SEQ ID NO: 60631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttactcctgtgaacgtttggctgtggggc

SEQ ID NO: 60632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttagacaatttcctcggcacaacaaatct

SEQ ID NO: 60633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttagaccagagagatgatgaccatcttag

SEQ ID NO: 60634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttaggaagtctggtataatattttcgagc

SEQ ID NO: 60635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttatccctcggcagcgcggaatcctgcta

SEQ ID NO: 60636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttcactcgtgatgggttcgatgacgtata

SEQ ID NO: 60637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttcatgcacgttgtcgaccttttttatat

SEQ ID NO: 60638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttcccttcttgcgcagtgggttatggggt

SEQ ID NO: 60639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttcgagaggacgcacatgggttgagatga

SEQ ID NO: 60640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttcgggtcgttcggagcgagtgaacattt

SEQ ID NO: 60641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttctaggagacaacgaaccccgcgtcgtg

SEQ ID NO: 60642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttctcattgcgcaggtggaatgtatgttg

SEQ ID NO: 60643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttctgcaggtgaggacacacaaagggatt

SEQ ID NO: 60644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttctgggcaatgggttcgcgatcttgggt

SEQ ID NO: 60645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttctgggcataagttgatcgctcgatctc

SEQ ID NO: 60646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttgacgtatgtacgagtattatcatggtg

SEQ ID NO: 60647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttgcacacagtccttcgtgcttacgaact

SEQ ID NO: 60648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttgcagagttacgtgcaatgtggcagttg

SEQ ID NO: 60649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttgcatccgggaacgcgccttgtcaggag

SEQ ID NO: 60650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttgccttgtgaatgagccgcatggtgcca

SEQ ID NO: 60651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttgctcaccatgaatctaaagaatacgtt

SEQ ID NO: 60652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttggccgtgcgacgtaggttacctgggaa

SEQ ID NO: 60653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttggcgttagcggatggtgtccatgttac

SEQ ID NO: 60654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttggtagctgcaatacatgtgttgcggga

SEQ ID NO: 60655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttgtcacttcagcttggatagactgtatg

SEQ ID NO: 60656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttgtccgagttagcgcgttttgatttgcg

SEQ ID NO: 60657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttgttgtccacggataccttcgttggctc

SEQ ID NO: 60658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtttaatcgctgttcgaattcggcacgtgg

SEQ ID NO: 60659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtttagagaatcgaaatatggtgccggaat

SEQ ID NO: 60660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtttcgtgagttcaatgttcgattcatcgc

SEQ ID NO: 60661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtttgatcgcaagggttgtactcgtccacc

SEQ ID NO: 60662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtttggagacccggccgcaccaaggagtgg

SEQ ID NO: 60663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttttcttaagcgttaggcatattttgaat

SEQ ID NO: 60664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttttgttggcatcgtttcactacggtggt

SEQ ID NO: 60665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagtttttgggtgggaagcaacctgcgcgatg

SEQ ID NO: 60666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tagttttttagtcacgcttaaggttagtcttg

SEQ ID NO: 60667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaaaatgcaacctacaaatgcgcggtatc

SEQ ID NO: 60668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaaacatccttccaaatgtgtgtgccagt

SEQ ID NO: 60669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaacgaactttgatctcatgcctaggtgc

SEQ ID NO: 60670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaataccctatgattcgttgcaaagttcg

SEQ ID NO: 60671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaattcttctaatgttgattgtcaattgt

SEQ ID NO: 60672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaatttctgctgcttgaattgcggggatt

SEQ ID NO: 60673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataacagtcattttaacgttcgctgtccggt

SEQ ID NO: 60674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataacatgcgcaactggttaatttggtttaa

SEQ ID NO: 60675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataacccttcgtgctttcttttcgactcatc

SEQ ID NO: 60676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataacggttattttttcttctgtcacccggt

SEQ ID NO: 60677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataacgtgatgatgccggcaatgaggtctcg

SEQ ID NO: 60678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataactatcccatacagacatgtcagctgca

SEQ ID NO: 60679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataactgcgctctaaacatcggcatccaccc

SEQ ID NO: 60680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataactggctatcccagatgtgctagtgtgc

SEQ ID NO: 60681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataactggtgcattcccgcagtctcgagaat

SEQ ID NO: 60682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataagaccgccaccgcttgcacaaggtccgg

SEQ ID NO: 60683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataagccaagtgacgttgcgattttctcgtt

SEQ ID NO: 60684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaggcatacagaggcaaagggttcatggg

SEQ ID NO: 60685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataagggccgtagttgaaggaggccggccat

SEQ ID NO: 60686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataaggggaaagccccttaaggctatcaaac

SEQ ID NO: 60687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataagtacatttgttcggcgtcattttgttg

SEQ ID NO: 60688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataagtggcttgtgttcgtctttcgtctgga

SEQ ID NO: 60689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataatactcgatcctaaccacatatccatcc

SEQ ID NO: 60690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataatccgcggcttatagtaccctccgtgca

SEQ ID NO: 60691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataatgtgatgccgcgtgtgaggatgagatg

SEQ ID NO: 60692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacacgtatgcgggcgcgcagcaccggcta

SEQ ID NO: 60693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacagcgagtatgtgtgtcttgtgcctcgg

SEQ ID NO: 60694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacatatacactctacctgtcatagccttg

SEQ ID NO: 60695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacatccgaatccagagatacttgctttaa

SEQ ID NO: 60696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacatcggataggctaaatagcgacccgtg

SEQ ID NO: 60697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacatctctttctctgcggcttaaggttgt

SEQ ID NO: 60698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacatgtgaccagtgttgatgtcctgtcga

SEQ ID NO: 60699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacattcttccttggttcttccagccccgt

SEQ ID NO: 60700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacccagcccagtcgcagcccggagataga

SEQ ID NO: 60701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacccgtgtggtggtagcagttgcttcttc

SEQ ID NO: 60702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacccgtgttcttggcagacagttagtgag

SEQ ID NO: 60703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataccggttcgatttcaatcgtctcactcgt

SEQ ID NO: 60704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacgacaagccgtgttctggggaattgtgg

SEQ ID NO: 60705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacgagctatgtcgctggggaattagcagg

SEQ ID NO: 60706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacgccgtggaatttactagctagacatag

SEQ ID NO: 60707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacgcgcgttagtccttgaccggttggggg

SEQ ID NO: 60708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacgcgggttaaagtggtgactatttttga

SEQ ID NO: 60709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacgggcggccgtgttcatcagggttgagt

SEQ ID NO: 60710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacggggattcatataacagcgcaacccta

SEQ ID NO: 60711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatacgtcggcggctagggtagcaacgtggcc

SEQ ID NO: 60712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactagccaggaccgtttgtttagtttttt

SEQ ID NO: 60713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactcgtgtctgatgagaactgctagtccg

SEQ ID NO: 60714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactctgtagggtcacgcgaagatcatccc

SEQ ID NO: 60715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactcttgtgtttcgataattggcatttgg

SEQ ID NO: 60716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactgaatctattccttcgtgggcattgcc

SEQ ID NO: 60717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactgcatcgtcgcccacggtttttccaag

SEQ ID NO: 60718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactgcgcggtatactaccgttggtgattc

SEQ ID NO: 60719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatactggtcaccccggggatcagaaccgtcg

SEQ ID NO: 60720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagaacttaatcaggtccagtgaaaggtgt

SEQ ID NO: 60721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagagaagtatctaggtatactggtgcaga

SEQ ID NO: 60722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagagacgtgcgatattatgcgatccggcg

SEQ ID NO: 60723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagatagacctggctctgtgctcctatcac

SEQ ID NO: 60724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagatgccagtagcctgaacctttgctccg

SEQ ID NO: 60725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagcaatttaattcactccagtatcatggc

SEQ ID NO: 60726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagcagcaaagttcggggcaacggttgggt

SEQ ID NO: 60727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagcaggaaaatcctgggaagctgtatacg

SEQ ID NO: 60728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagcaggtcgttacttagctaggttcttct

SEQ ID NO: 60729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagcataggtattagcccacctcgtctggt

SEQ ID NO: 60730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagccctctcatgctggtgtccggtcgggg

SEQ ID NO: 60731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagccgtacattacgctttctccatgaaaa

SEQ ID NO: 60732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagcgcagcacagaggtattacgactgttg

SEQ ID NO: 60733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagcggacttctcactattgccctgttctc

SEQ ID NO: 60734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagcggtcggacagccctgtgtaattgtgg

SEQ ID NO: 60735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagcgttcagttggcatcgttagggatcga

SEQ ID NO: 60736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagctcccgagatgtgttgattcaagcgta

SEQ ID NO: 60737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagctcttgcgtccggcaaacttacttttc

SEQ ID NO: 60738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataggcactctcgtctcgaaccctattgcgg

SEQ ID NO: 60739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataggcggtagcaggggacacgggttccgca

SEQ ID NO: 60740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagggcaggcaaactgaggcgagtgatcgt

SEQ ID NO: 60741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataggggaagacggttgagggataaaaggcc

SEQ ID NO: 60742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataggggatttggctcaaaatattttgttgt

SEQ ID NO: 60743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataggtctagtgggggctactatggtactct

SEQ ID NO: 60744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tataggttcgtaatttcctagactttactcac

SEQ ID NO: 60745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagtaccctcgaacaaggtttatgcttctc

SEQ ID NO: 60746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagtagtgatatgacactttttcaacggtg

SEQ ID NO: 60747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagtcctagtgttggtgaatgggccgggtg

SEQ ID NO: 60748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagtcgccgggtctcgcctttcggaaaact

SEQ ID NO: 60749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatagttctccacaactccgagccgattcagg

SEQ ID NO: 60750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatataccgacaggcgcagtatgttggggttt

SEQ ID NO: 60751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcacgccgtacatgttccgatggcaggg

SEQ ID NO: 60752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcagggggatgtctcgttcattgggtgg

SEQ ID NO: 60753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcatcgtatcactccttgccggtgttgc

SEQ ID NO: 60754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcatgtcgcaataagttgatgtatgcgc

SEQ ID NO: 60755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcctaggtaggtggaacaaggtgtgcca

SEQ ID NO: 60756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcgattgtacactgcggttggatgcaag

SEQ ID NO: 60757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatcgcggacagggggtcccatggatctgt

SEQ ID NO: 60758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatctatggcggtcgattggatgtttcctt

SEQ ID NO: 60759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatgcgtttcatagcattttaaagacctat

SEQ ID NO: 60760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatggaacaatccggctgttgtccttgcgg

SEQ ID NO: 60761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatggctttccgtctcgtccctgttgaacg

SEQ ID NO: 60762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatgttggagcagcactgttttaccgctta

SEQ ID NO: 60763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatattataccgcgtctgtcttaaggatgctt

SEQ ID NO: 60764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatattccgccgcatcgaacaccaaagaagcc

SEQ ID NO: 60765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatattctgattaggagagacttcgctgctta

SEQ ID NO: 60766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatattgacgatgtttgtttgacagttggttt

SEQ ID NO: 60767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatattgctactttactgtgggaccgtgtctt

SEQ ID NO: 60768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatattgctgatggttcaagtcaaacgggttc

SEQ ID NO: 60769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatttaacacccgtgtgcgctcatgtgtgg

SEQ ID NO: 60770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatttaatttggccggctcttgcgccctat

SEQ ID NO: 60771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatatttacagactgcgtatacgtccccatat

SEQ ID NO: 60772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaaagacggctagacacgaccacagccgg

SEQ ID NO: 60773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaaatgatcggtaacgcgggtaaactatc

SEQ ID NO: 60774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaacgacaaagtccgatgttgccggaggg

SEQ ID NO: 60775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaagatggaacgtgctgacatgttctcgt

SEQ ID NO: 60776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaagctagcagatccaggcccgtaacatc

SEQ ID NO: 60777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaagtagactaattcagcatcaggcgtac

SEQ ID NO: 60778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaagtagtcccctcgcgtcgtcatccggc

SEQ ID NO: 60779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaatgtagtcttccaccaaggtcacgtgg

SEQ ID NO: 60780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaattcagggcatccgggtcttttcttac

SEQ ID NO: 60781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacacgcttaggggcacaccggtgggcac

SEQ ID NO: 60782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacagatgtttgagagtaagactggctcg

SEQ ID NO: 60783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacaggccaagacacctctgcatgccatg

SEQ ID NO: 60784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacattagatttgccccacaccagggctt

SEQ ID NO: 60785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaccggaaacagtcatctcgacccgcatc

SEQ ID NO: 60786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacctccagaacgggagagtttgaccgac

SEQ ID NO: 60787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacgaagatacgtgtcgagcgtgctatgc

SEQ ID NO: 60788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacgaggcatccacgccttcgggtcggtt

SEQ ID NO: 60789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacgcgcggggcaccgagacggttacggg

SEQ ID NO: 60790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacgcggcgggctccatcacgatcggtcg

SEQ ID NO: 60791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacgcgtattagagtcactcacgaggtgc

SEQ ID NO: 60792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacgtatgtcatctagcgagttcccgcgc

SEQ ID NO: 60793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacgttctgcaatttatgcagttcgcttg

SEQ ID NO: 60794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcactcattctgtcagaggacaagacaacg

SEQ ID NO: 60795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcactcccgcccgggcttgcgtaccaactc

SEQ ID NO: 60796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcactgtccgtttaaatagggcttgtttag

SEQ ID NO: 60797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacttcacattgagttcaatggctaaacg

SEQ ID NO: 60798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacttcacgtctttggtccgctccggagg

SEQ ID NO: 60799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcacttctcgactcgcatcttctcttgtcg

SEQ ID NO: 60800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcactttaggtgcgtggcgagtagccgaac

SEQ ID NO: 60801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagacaggcgccaaagagtacccagtgag

SEQ ID NO: 60802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagacattttttacggagaggggaaaccc

SEQ ID NO: 60803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagacgggagccaatgtccagtatttttc

SEQ ID NO: 60804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagaggtggagtgactgcaaaaactcgga

SEQ ID NO: 60805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagctcagcgcaatgaacgtatgcggtat

SEQ ID NO: 60806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagctccacgtgcgaatccacgtatgacc

SEQ ID NO: 60807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagctccacgttacagttgggcaccatct

SEQ ID NO: 60808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaggaatggctcgtcgtcagcaagatctg

SEQ ID NO: 60809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaggacccgtctcctcctcgtggttgagc

SEQ ID NO: 60810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaggactaattatgctgtaactgacgcgc

SEQ ID NO: 60811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagggaaggtcgggtgcccttgtctatct

SEQ ID NO: 60812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaggtacgaagctacgtcggcgataggcg

SEQ ID NO: 60813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaggtatctccaccttgagggtgttctaa

SEQ ID NO: 60814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcaggttatacaggtggaagcgctctgaat

SEQ ID NO: 60815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcagttctagccttatacatgcaagaatgc

SEQ ID NO: 60816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatacgaggtgctatgccgttcagcgtcg

SEQ ID NO: 60817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatcccatgggcagtctgtagtacggatc

SEQ ID NO: 60818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatccgtggtcacgagttgactaatatcc

SEQ ID NO: 60819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatcgcaactggccacgttcactgcccca

SEQ ID NO: 60820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatgagtttgctcgtcgcttcaactgtga

SEQ ID NO: 60821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatgttaacgagtgccttgacctcttgcc

SEQ ID NO: 60822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatgttaacgtggtttgctcaacatattg

SEQ ID NO: 60823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcattactcaaacgagcgaacgcatccgtg

SEQ ID NO: 60824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcatttcgtgagaagctatggaggatttgt

SEQ ID NO: 60825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccaaagtattaggcactctggccattcta

SEQ ID NO: 60826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccaacacctagggcctgcccatccttcgt

SEQ ID NO: 60827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccaagtgtaaagttgaggggctattcgtt

SEQ ID NO: 60828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccacgcgtcgtgcagtcctactgttcacg

SEQ ID NO: 60829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccagatctaaaccagctcctttgccctct

SEQ ID NO: 60830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccagctgtgaaagaactctcgcgttcatc

SEQ ID NO: 60831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccagggcgtaaaggtttttctcggtactc

SEQ ID NO: 60832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccaggggcagtgcgccatagttcgtcgaa

SEQ ID NO: 60833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccaggtgttgcaggcgagatctgtccctt

SEQ ID NO: 60834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccattagggatagtcctgctatggattgg

SEQ ID NO: 60835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccaggctactccgggctgctttggcacg

SEQ ID NO: 60836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccatattgcatttgtcttgagggagttg

SEQ ID NO: 60837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccatttatcgctcgaggttgcacatcac

SEQ ID NO: 60838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccccgagttgatccttccgtgcgagcgga

SEQ ID NO: 60839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccccgatcgaagtatgggtctttaatggc

SEQ ID NO: 60840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccccgctgtgactggtatggtgggggtga

SEQ ID NO: 60841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccccgggagcccggactttccaaccgagg

SEQ ID NO: 60842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccgaggcgctctcgactccttgatgtcg

SEQ ID NO: 60843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccgccgtcttcggttaacgagcgactca

SEQ ID NO: 60844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccggactagtgtattgccacagactttc

SEQ ID NO: 60845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcccggccctctaccatgggcatatcggca

SEQ ID NO: 60846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccctagccattagtagacgtcgcccctat

SEQ ID NO: 60847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgagggctggtcgttaagggatgcctgt

SEQ ID NO: 60848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgattatgtgtttagggctctcgggaga

SEQ ID NO: 60849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgcgccccacatgatattgacataagca

SEQ ID NO: 60850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccggaagtacggcatcacatgtggcaaca

SEQ ID NO: 60851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccggctggttaggtgtgtagattatcgtt

SEQ ID NO: 60852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgtaaacgaatagttcggattatattgg

SEQ ID NO: 60853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgtccttgccaagttgtgattgttgtcc

SEQ ID NO: 60854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgtggaactcttttcctcccctggcgcg

SEQ ID NO: 60855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatccgttcaaggtcttcagcgacattgggcg

SEQ ID NO: 60856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctaaaagtgatccagcagactacgagac

SEQ ID NO: 60857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctcctgagcttgattggacgtcgccgcc

SEQ ID NO: 60858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctgagcaacaatgaccacactccctatg

SEQ ID NO: 60859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctgccactacgcgggaggtaaagggtgc

SEQ ID NO: 60860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctggagatcaacgcggaagtggggttcg

SEQ ID NO: 60861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctttacttcattccgtacaaacgcgtcc

SEQ ID NO: 60862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcctttgctctgtttggttgcggcggttgg

SEQ ID NO: 60863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgaaccgagaacattttcgtactagatgc

SEQ ID NO: 60864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgacacagggagctggtcacgaatatgct

SEQ ID NO: 60865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgacaggtaatcctgaatgtgatataagg

SEQ ID NO: 60866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgaccagtcttagtgaatggtatcgttgg

SEQ ID NO: 60867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgacccagtttaacaccattccttgcgtg

SEQ ID NO: 60868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgagatgcgatggcagggttttcgtttcg

SEQ ID NO: 60869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgagcccaggtgacgaaacgcacaggtga

SEQ ID NO: 60870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgaggccgccgtacctgtgtattgtggtg

SEQ ID NO: 60871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgaggtgaggagacacttcatcaaataca

SEQ ID NO: 60872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgatatctcgggtgttgaggcacggcctt

SEQ ID NO: 60873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgatcctgcgttcgttgtttcgggtcttg

SEQ ID NO: 60874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgatgtgaatcaccccacacggccacggt

SEQ ID NO: 60875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgattactcaaacttccttgagacataat

SEQ ID NO: 60876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcacgtattaatccgcacgagatatctt

SEQ ID NO: 60877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcagcctcggtgattaattgcgatgtag

SEQ ID NO: 60878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcagggccttctagatttcacttgaggg

SEQ ID NO: 60879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcagtatgctacgagcttgagtcagtcg

SEQ ID NO: 60880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgccgtacatgctcaagaaacgtacttca

SEQ ID NO: 60881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcctcgaccagtttcacgcaggcaagcg

SEQ ID NO: 60882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcgaccgattttggcgagttgtggttca

SEQ ID NO: 60883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcgcgtgagtgtcgagaatacggagtta

SEQ ID NO: 60884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcgtgtgcgcatagtttcccttgggcac

SEQ ID NO: 60885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgctcggtggacgctttgtagagaagtgt

SEQ ID NO: 60886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgcttcaaacaacgcgctaggttcacggc

SEQ ID NO: 60887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggacgggcgttgtctaagatcatcggct

SEQ ID NO: 60888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggaggtgcatactcttatctcgtgctaa

SEQ ID NO: 60889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggcaccgaggccccggaatgggagtttc

SEQ ID NO: 60890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggcactctggcagccgccttcgctcgat

SEQ ID NO: 60891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggcataaaaactagtccgctgtgcatgg

SEQ ID NO: 60892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggcatatcccttgatggtcttggttaca

SEQ ID NO: 60893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggccgggtctgcttcaccgttccttctt

SEQ ID NO: 60894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggcgcgctctcaatcagttggtcaggat

SEQ ID NO: 60895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggcgtctgtcccatctagatccacaatc

SEQ ID NO: 60896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgggcgagactgaggcacgcgcgaagttg

SEQ ID NO: 60897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggggaaacaccgcttctgtgccgtggtg

SEQ ID NO: 60898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggggctaatgctctgtccgggtgctctg

SEQ ID NO: 60899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgggggatacgggctaggctacctaagcc

SEQ ID NO: 60900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgggtctcgtccatgcgtttgcgggaact

SEQ ID NO: 60901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggtcattgcgccggtcagcccagagacg

SEQ ID NO: 60902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggtcgcgaatcgtgttcatggaatgtaa

SEQ ID NO: 60903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggttgagttagtgatgggtgtgcacctt

SEQ ID NO: 60904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcggttgcctcgcatagtggagttcggtgt

SEQ ID NO: 60905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtactaaatgcttacgcctcgtccaata

SEQ ID NO: 60906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtaggcggcaaaaccgattccactgttt

SEQ ID NO: 60907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtagttgccacgtcatgctcccctgcta

SEQ ID NO: 60908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtccacgctcttagtaccactacccgag

SEQ ID NO: 60909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtcctttttccttcatgtggttctgcgc

SEQ ID NO: 60910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtcgagcgcaaggtatcctttagcctca

SEQ ID NO: 60911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtcgcgggaatcaatgcttggtgaaata

SEQ ID NO: 60912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtcgggtcagcgactgagggggcttatt

SEQ ID NO: 60913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtcgtggccagacgcgaagggccggcgg

SEQ ID NO: 60914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtgaaggtacgcaaagcggcgttgaggc

SEQ ID NO: 60915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtgaatcggagcatcaccttcgtctcgg

SEQ ID NO: 60916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtgaatggttgctggtctcttgcccgta

SEQ ID NO: 60917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgtgccgtcccgcccagcacatgttttgc

SEQ ID NO: 60918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgttcctgtaggagctcccgatatctgct

SEQ ID NO: 60919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgttgatggggcgtccgggtagatcgcta

SEQ ID NO: 60920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgttggttttgatgtaatgttgccgcgcc

SEQ ID NO: 60921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcgttttgaggagcggttagcgttatcatc

SEQ ID NO: 60922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctaagtggtggagggggcaggttgaggta

SEQ ID NO: 60923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctactaccggggcgaccacgtgccgctgc

SEQ ID NO: 60924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctagaactactcaaaagactggcccgatt

SEQ ID NO: 60925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctagagtgcggcccgaatagactttgtcg

SEQ ID NO: 60926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctaggcacgcttgagacgtatgagcctct

SEQ ID NO: 60927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctagtaagaactatcagaccggttaactc

SEQ ID NO: 60928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctcagcagacgcgtttccgttgaaatctg

SEQ ID NO: 60929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctccaccctctcacacgtggcacacggtt

SEQ ID NO: 60930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctccgtatcttgcctttgatagaatgagt

SEQ ID NO: 60931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctcgagctcatttgatgtcgtacgagaag

SEQ ID NO: 60932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctcgccgttcagtgcccgcctatcgggtg

SEQ ID NO: 60933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctcgcctcgtgcggtcgtctaaagatcct

SEQ ID NO: 60934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctcgtgatggtatgccccggtctgatttc

SEQ ID NO: 60935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctcgtgtccagcccggctcgcaaggatta

SEQ ID NO: 60936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctctaacattcgactccgactcagtcaac

SEQ ID NO: 60937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctctaccatatataagatcgtacatatcg

SEQ ID NO: 60938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgacggctgggaatgtttgcatgcattt

SEQ ID NO: 60939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgatagtcaaatgatcgttttatgtact

SEQ ID NO: 60940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgcacgggtttccgctgaaagtcttccg

SEQ ID NO: 60941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgccggaggttttggctttaataggtgg

SEQ ID NO: 60942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgcctccgttggacctgcgagagccgtg

SEQ ID NO: 60943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgcgagggacgattgtttcgtaattgcg

SEQ ID NO: 60944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgcggtagactgactcgagtaaccgtcc

SEQ ID NO: 60945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgcgttgcgcgattatctggcggcacaa

SEQ ID NO: 60946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgctagccccgccaagatcgattgactc

SEQ ID NO: 60947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgggattgtgatatgttgttctgttaga

SEQ ID NO: 60948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgggcggaatgattgccacggcgaatcc

SEQ ID NO: 60949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctggtactgtgtcagtaaccgaattctcc

SEQ ID NO: 60950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctggtccggcaatctgggttctgttgtga

SEQ ID NO: 60951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgtacacgccctcggatttgttggcgct

SEQ ID NO: 60952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgtaccgagaagcttggtcgtcctgtct

SEQ ID NO: 60953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgtaggaaatgtgggttacgactcatac

SEQ ID NO: 60954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgttgcttagttcatttgttgttggtgt

SEQ ID NO: 60955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctgttgtgtttgatcttagcccgatagtg

SEQ ID NO: 60956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcttatgggacggttttggtccggagtact

SEQ ID NO: 60957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcttcctgaggattttggtaccctctctaa

SEQ ID NO: 60958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcttgaggacacatgtcccgcagtaagaat

SEQ ID NO: 60959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcttgcatgtaatcaatccgctatttgtgc

SEQ ID NO: 60960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcttgcgatcgttctggtcggtcctcggag

SEQ ID NO: 60961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcttgtttgttagccatcaagcggctcgcg

SEQ ID NO: 60962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatctttaactaattctacatatatctcaaac

SEQ ID NO: 60963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatcttttatcgatgaattttggtggtgtgtt

SEQ ID NO: 60964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaaaaagtgacttaaacctcatccctcga

SEQ ID NO: 60965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaaacgttgtctgctatctactagggttt

SEQ ID NO: 60966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaaagactgagctttattttgacgcagac

SEQ ID NO: 60967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaacgtagtcctttgcatgaggccggtga

SEQ ID NO: 60968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaagagctcctcgtcgataatggtgaccg

SEQ ID NO: 60969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaaggactcagccgaatgggctggtacac

SEQ ID NO: 60970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaagtgaagcgtggttttttgctcccagt

SEQ ID NO: 60971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacaaggcgcatacggtgtactctatcgg

SEQ ID NO: 60972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacaagtccgagcccttcaggaggtgcgg

SEQ ID NO: 60973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacatcggggaccaagatgcaatgcgcga

SEQ ID NO: 60974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaccccgcggagcaagttttacgatctac

SEQ ID NO: 60975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaccggtctcgaggagggggcaatgatat

SEQ ID NO: 60976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacctgcgacttcacgactcattcccgcg

SEQ ID NO: 60977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacgatgtaaggatggactcccggcgttg

SEQ ID NO: 60978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacgatgttcccatttggcacattacgcc

SEQ ID NO: 60979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacggacaagaatccagagtgcttgacgc

SEQ ID NO: 60980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacgtgtacagtttaactcccagaagccc

SEQ ID NO: 60981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgacgttagcttataacagtggttaaagga

SEQ ID NO: 60982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgactgggtgcaaaccgggattggttgacg

SEQ ID NO: 60983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgagattcgactcaggttctgactggctgc

SEQ ID NO: 60984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgagccagtggaattgtcgccaggctgctg

SEQ ID NO: 60985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgagcgacccgccgaggcggagcatgggca

SEQ ID NO: 60986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgagctagggaaagcaattcatcggcatac

SEQ ID NO: 60987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgagctcaatgtgttatcttggtacacgaa

SEQ ID NO: 60988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgaggtgcgctcctgttcaatttaaagcta

SEQ ID NO: 60989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgagtgtcggcggtcctgctggaggtgttc

SEQ ID NO: 60990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgagtgtgtttcaaggaagagcgcaggtcc

SEQ ID NO: 60991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgataacctatctactcggctcattacggt

SEQ ID NO: 60992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgatccaggattgctctcctgcccctgttt

SEQ ID NO: 60993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgatccgtgagggatatggacgccgcgtgc

SEQ ID NO: 60994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgatcgctcgatatgtgcgtaagtgggagg

SEQ ID NO: 60995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgatggttaccgatttgacttaatattctc

SEQ ID NO: 60996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgatgtattgttgataaacactgtgcgcgg

SEQ ID NO: 60997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgattaagaacgcggtgcggcgaacttccg

SEQ ID NO: 60998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgattacaagccatcaggcaacttagcagt

SEQ ID NO: 60999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgattacgtctgcccgttctcgacttgctt

SEQ ID NO: 61000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgattagctctgtgttaatcccatggccgc

SEQ ID NO: 61001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgatttgatctgtctcgtccgtcgttagtc

SEQ ID NO: 61002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcaaaccatgctagttgtgaccaggctca

SEQ ID NO: 61003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcaacgcctatgttgatcagctccgggga

SEQ ID NO: 61004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcaactcagcgtcgttcttcggggtagtg

SEQ ID NO: 61005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcaagtgggggatcgaatagctaattagg

SEQ ID NO: 61006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcaccctatgtattcgaccgggcaatgcg

SEQ ID NO: 61007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcacgattgcgcgggtttggcttacgcac

SEQ ID NO: 61008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcacgcgagtgtcatgggtgcggattgtt

SEQ ID NO: 61009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcacggagtataggtatggggttggtttg

SEQ ID NO: 61010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcactcaagctccatcgtatgtaagcctc

SEQ ID NO: 61011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcaggaactcaaacaacttgacttttcga

SEQ ID NO: 61012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcagggcttgttgttttcatagcgtcgac

SEQ ID NO: 61013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcaggttagaaatttgtccgttccacgaa

SEQ ID NO: 61014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcatagagcaattattgtaccgtggcaag

SEQ ID NO: 61015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcataggaaagcgatctaattaacgcttt

SEQ ID NO: 61016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcataggaacctgaggggtgtgtggctgt

SEQ ID NO: 61017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcatgggcgcatagcagcatcggggctgg

SEQ ID NO: 61018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcatgtagtgatcattccagctccatcgg

SEQ ID NO: 61019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccaaagggatgctcatagtacgagggaa

SEQ ID NO: 61020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccaccggagtttgcgttgctcagccttc

SEQ ID NO: 61021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccacggtaggttctagccctgtgattct

SEQ ID NO: 61022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccagcgtgctactacccaattctgcggc

SEQ ID NO: 61023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccagcttgtattaacggaagatcgccgc

SEQ ID NO: 61024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcccacagccaaagttagactatagctat

SEQ ID NO: 61025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcccatttgagtgagattactttctccac

SEQ ID NO: 61026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccccgtatggcctacttagaacttctaa

SEQ ID NO: 61027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcccgcgagcaggtatgcagcaccatacc

SEQ ID NO: 61028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccctgggaaccgcgcggactggacagat

SEQ ID NO: 61029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcccttgacacaggtaagcgctggtttca

SEQ ID NO: 61030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccgagaaaacgccaggtttggattcatg

SEQ ID NO: 61031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccgagtgccgcaggtgcccgtagcggac

SEQ ID NO: 61032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccgccagtgtgcaaggaagaatcaccgg

SEQ ID NO: 61033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccgcgagcgctgttggggttaagcgtta

SEQ ID NO: 61034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccgcgctgtgcgtcctacgttcaacatt

SEQ ID NO: 61035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccgcgtaaagggacgcgcaactttgtac

SEQ ID NO: 61036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccgctcatttccacgctttctcgagtta

SEQ ID NO: 61037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccggatggactggatgtatagcaaccga

SEQ ID NO: 61038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccggcggggatcgtgtatcgccttacgg

SEQ ID NO: 61039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccggtcggatctcgcagcctttcgctcg

SEQ ID NO: 61040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgccgtgccggtagggtccatcggtcgtgc

SEQ ID NO: 61041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgacggctaattgtaccatacgctcggt

SEQ ID NO: 61042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgactgttatatgtacctttcgaggcgg

SEQ ID NO: 61043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgaggcaatggtagacttctccccggat

SEQ ID NO: 61044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgagtggtgatgttttcgtgttacgctc

SEQ ID NO: 61045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgatgcctttaccctcccgtgcccgaat

SEQ ID NO: 61046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgatttggatataagaatcgaccagcgc

SEQ ID NO: 61047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgcagcgatcaggagggacggtgcggcg

SEQ ID NO: 61048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgcgcatctcttactagatcgatcggcc

SEQ ID NO: 61049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgcggggggattgcttgtcttgcgcccg

SEQ ID NO: 61050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcggatcgcaagtttctcagataggtaca

SEQ ID NO: 61051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcggatcggtttcgtggtccggaaaattg

SEQ ID NO: 61052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcggccccaggacttccctaacgagccgt

SEQ ID NO: 61053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcggcctaagcaaaacatggatcggctga

SEQ ID NO: 61054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcggcgatcgggcggtcgtccggtagtgc

SEQ ID NO: 61055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgggaattgatctgacccgggcgacact

SEQ ID NO: 61056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgggcacgcgaattctttttgcgggtct

SEQ ID NO: 61057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcggtggttcttggggcgagaacatgtcg

SEQ ID NO: 61058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgtccggctcattcaatgtcctgagagc

SEQ ID NO: 61059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgtcgtgtgtcggccgtatcacgggctt

SEQ ID NO: 61060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcgttaaagacacttcctcgctggtgcac

SEQ ID NO: 61061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctaaagtttgtttcgtagcttttaggca

SEQ ID NO: 61062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctaaatacgaacagacggcacggggttc

SEQ ID NO: 61063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctactaggtgaccaggcatggccggtgg

SEQ ID NO: 61064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctaggttagttcctctatatcttttgta

SEQ ID NO: 61065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctatagacaatggtccaggaatggttga

SEQ ID NO: 61066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctatctacgttttgattcatgggggtcg

SEQ ID NO: 61067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctattaaagaatccatcgttccattcat

SEQ ID NO: 61068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctcacgtttgaaaggtcctcggctgttc

SEQ ID NO: 61069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctcgccctgccaactccgcttctaatcg

SEQ ID NO: 61070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctgacccagctctcgactgcttgggttc

SEQ ID NO: 61071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctgattgagaacgtttgggcatccccct

SEQ ID NO: 61072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctgcaccagcggccataaaacagggagg

SEQ ID NO: 61073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctgccactgacaggactgcatgcttcgt

SEQ ID NO: 61074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctggagaatcgtaatccgccggacacgg

SEQ ID NO: 61075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctgttaaaatgtcctgggtaatcttatg

SEQ ID NO: 61076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcttcccactgttatctgtggcggaggcg

SEQ ID NO: 61077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgctttgttgtgattctaaattcacgggtt

SEQ ID NO: 61078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcttttatgcaatgtaggccgctccaggg

SEQ ID NO: 61079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgcttttcgacgtttcaatgtttagatttc

SEQ ID NO: 61080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggaaacacctctttgtggcttatccccta

SEQ ID NO: 61081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggaagcgaatgttttgcaacgtcgttctg

SEQ ID NO: 61082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggacggaaactgaggtgggacataactga

SEQ ID NO: 61083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggacgtttttttgcgtcttttgggtcatt

SEQ ID NO: 61084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggagagccgagtggggttgcgccgtggat

SEQ ID NO: 61085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggaggcttagtttaagagcaggtgacctt

SEQ ID NO: 61086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggaggttcatgcacacgaagccttccatc

SEQ ID NO: 61087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggatactgcatatagggcacgaacggtgg

SEQ ID NO: 61088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggatcggtccatggtcgcgtcaacgcttg

SEQ ID NO: 61089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggattcaatgtctgatggcaagggacata

SEQ ID NO: 61090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggattgctagttacatctgggcggcgatc

SEQ ID NO: 61091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggatttctctggctctttatggagcgcac

SEQ ID NO: 61092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcaaaaaactgtggggtgcttgtaagga

SEQ ID NO: 61093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcaacgactcgttcttgccgtgatcgct

SEQ ID NO: 61094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcaatgctaagttcctagtttccagttt

SEQ ID NO: 61095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcacgggggactgacgatttcgcctgtt

SEQ ID NO: 61096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcactaatcggaaccttattgtgcttgc

SEQ ID NO: 61097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcatcgatggataacaaaggattataga

SEQ ID NO: 61098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcatttccagcgaatatgttcactcttt

SEQ ID NO: 61099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggccgtgggaacagacaggtcctcgccca

SEQ ID NO: 61100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcctctcgggtccggatatgggtcgacc

SEQ ID NO: 61101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggccttagtgtagaacaccgacttcattg

SEQ ID NO: 61102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcgaagcaggcctgcgaagactgtttca

SEQ ID NO: 61103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcgatgcagtccttgctttgcagagttg

SEQ ID NO: 61104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcgcgatgatttttgttgacgggagcct

SEQ ID NO: 61105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcgtgaactactcagtgttgctccggcc

SEQ ID NO: 61106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggcgtgtcgttaaatcaccatccgcagtc

SEQ ID NO: 61107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggctgtccggtgggatttaacgcccgttc

SEQ ID NO: 61108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggaactcaattatacttttgcgctttac

SEQ ID NO: 61109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggagggcgagtggatcatgttgcttggc

SEQ ID NO: 61110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggatcaccggactctttaaccaacggac

SEQ ID NO: 61111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggatctgtatcgaggacaaacagctggg

SEQ ID NO: 61112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggattgcgacggcatagtttgggaactc

SEQ ID NO: 61113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggcatcgactaggagactttctctcggc

SEQ ID NO: 61114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggccctcacaggaccacgcgcagatcgc

SEQ ID NO: 61115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggcggcggcggggttccggttcgtcctc

SEQ ID NO: 61116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggcgtgacagcgcattgtcgctgggatg

SEQ ID NO: 61117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggcgttgtgactgacgaattggagatta

SEQ ID NO: 61118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggctatccgacggcgttgcacgtccggc

SEQ ID NO: 61119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggctctatactggcgttcctggactgtc

SEQ ID NO: 61120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggctgaggtttgccgcgggtctcaatgt

SEQ ID NO: 61121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggggatgtgtgagcgcaataagaggaagc

SEQ ID NO: 61122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggggcagagcatagaggttagatgtcgtc

SEQ ID NO: 61123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggggcgcaacctttggctttctacgtcg

SEQ ID NO: 61124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggggtcattgggtttctcacctaccgggt

SEQ ID NO: 61125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggggtgcgttaggtctgccctcactttat

SEQ ID NO: 61126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggggtggtggtgtcttatttctgccttac

SEQ ID NO: 61127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggggttagttggagggctttactcgtatt

SEQ ID NO: 61128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggtactagagcctagtcttctttaaatg

SEQ ID NO: 61129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggtccagtcaaagcccttgattctcgga

SEQ ID NO: 61130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggtgccatggccaacactatccgcccgc

SEQ ID NO: 61131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggtgggagacatctcaaacaatgctcgc

SEQ ID NO: 61132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgggttttgcagatgcagccaactcgccca

SEQ ID NO: 61133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtaatgaatcagcaatcctccgttggtc

SEQ ID NO: 61134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtacctttgggcagactgtcgaagttta

SEQ ID NO: 61135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtaggaggtgtcagtatctgcctttctg

SEQ ID NO: 61136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtatacggataagccctgttttaagcca

SEQ ID NO: 61137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtccacaaggtgaagaggcatcgcatgg

SEQ ID NO: 61138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtccggaacctcgttccactgttttgcc

SEQ ID NO: 61139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtcgctgtcccttttctaccggctcgcc

SEQ ID NO: 61140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtcttccgcttatatcgttgttgatggg

SEQ ID NO: 61141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtgaacacgtcactatcgggatagacgg

SEQ ID NO: 61142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtgccagcggtggagtggattgcggcgg

SEQ ID NO: 61143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtggttccgggccgggtagatcgctcgt

SEQ ID NO: 61144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggtgtcctggaccgaggacaatcagcttg

SEQ ID NO: 61145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggttaaaggaggttgctggcgatcattgc

SEQ ID NO: 61146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggttcacggttagcaggccaagcactgtg

SEQ ID NO: 61147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggttcctatcggggacaatgctaggttcc

SEQ ID NO: 61148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggttgcttcgagtggggatcggcaatgca

SEQ ID NO: 61149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggttgtaacgcgaccaggttctcgggggt

SEQ ID NO: 61150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatggttgtcattcgatactgcttcttactag

SEQ ID NO: 61151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtacgggtaaattggaacagagcttttct

SEQ ID NO: 61152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtacgtcttgcttcaatgcgcagggcgat

SEQ ID NO: 61153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtagagaaatccgcgtaggacactttaac

SEQ ID NO: 61154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtagcgcgcggccagctctagcttcgttg

SEQ ID NO: 61155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtaggatgttggccaaagtgttagtgcga

SEQ ID NO: 61156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtagggcttagcgtttcgctttgggaata

SEQ ID NO: 61157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtatcaggccgaggacagtgcatattgct

SEQ ID NO: 61158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtatcgcaagaggcaccggaattactctc

SEQ ID NO: 61159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtatgtacgtggtgtctgcggccatgggt

SEQ ID NO: 61160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtcagttggcttaagtatctggtgcttga

SEQ ID NO: 61161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtcatacttaacttgccttaaccatgcgt

SEQ ID NO: 61162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtccacgccaatggcgaatgagttcagtc

SEQ ID NO: 61163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtccaggaatcttttggatcaatgggaga

SEQ ID NO: 61164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtccgaacgaggtagctggtgcccttttg

SEQ ID NO: 61165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtccggcgatcatggattcgtcttttgtc

SEQ ID NO: 61166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtccgtggcggttccgtggtgggggaggg

SEQ ID NO: 61167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtccttggggcctataattctctcccacg

SEQ ID NO: 61168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtcggaacgttactctaatcggtgcgggg

SEQ ID NO: 61169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtctcggatcggtgttccagcgcgttggt

SEQ ID NO: 61170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgacatgttgcccgacccgcgttgaagg

SEQ ID NO: 61171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgaggttagtgagtggatctacctagac

SEQ ID NO: 61172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgatgatggtttttgggatctatctgga

SEQ ID NO: 61173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgatggataacaattctacgttcggtag

SEQ ID NO: 61174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgccacacccgttcgtgcgtcaactcgg

SEQ ID NO: 61175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgcgaactttctgtttgggaaggattgg

SEQ ID NO: 61176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgcgattactacaccgactcgtggtctc

SEQ ID NO: 61177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgcgcgtcttcggatcaccgttattcgc

SEQ ID NO: 61178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgctctcgcatggccgcaagacaggcct

SEQ ID NO: 61179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtggcacaaccaggctggctctggctctg

SEQ ID NO: 61180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtggccccgcgtttgtgccgcaccgcacg

SEQ ID NO: 61181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgggattgctcgactgcctctcattaga

SEQ ID NO: 61182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtgtccgagagcctgagttaggacccgcc

SEQ ID NO: 61183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttaccatgtgcatttgttgaggtggccc

SEQ ID NO: 61184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttagaccagtggggtccgcgttgttata

SEQ ID NO: 61185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttatccgatttaattcatcggtatgcaa

SEQ ID NO: 61186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttcgtacgctcgcggctagcaggacatg

SEQ ID NO: 61187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttcgtaggtatgttgtgccgcgggttgt

SEQ ID NO: 61188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttctagcattgccatggtataagtaagc

SEQ ID NO: 61189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttctgcaacttctatttacgcgggtgtt

SEQ ID NO: 61190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttgagtaccatgacgcccagcactagcg

SEQ ID NO: 61191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttggtcgggattcagggtcattcactgc

SEQ ID NO: 61192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttgtacaactcctttggccactctgtgg

SEQ ID NO: 61193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgttgtcagcggaggaggtatgtgtacgag

SEQ ID NO: 61194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtttatgttctattggtatggccttattt

SEQ ID NO: 61195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatgtttgggtccggatgctattacaacgttt

SEQ ID NO: 61196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaaaaaaacgccgtcccatatttgtaaag

SEQ ID NO: 61197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaaagggatttgtacgtattagggaggta

SEQ ID NO: 61198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaaatctcgggtggtccagggtaagattg

SEQ ID NO: 61199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaagccgttagagtccgttggccgccacg

SEQ ID NO: 61200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaatagagtatggcctccacatcatgtgc

SEQ ID NO: 61201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattacagggtgattgatgatgatagggattg

SEQ ID NO: 61202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattacgcctgatctgccgaagtgccatgcgc

SEQ ID NO: 61203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattactcaccggtttaggtatcgcgtatgaa

SEQ ID NO: 61204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattactgaatactgctgtgtcgatgggaatg

SEQ ID NO: 61205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattactgtgcgtgccacccggcctgttttat

SEQ ID NO: 61206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattacttctcagcatcaacttcatcacgggt

SEQ ID NO: 61207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattacttctcttcatggatgctctcgcctca

SEQ ID NO: 61208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattacttgcgacctctagcatatccccccgc

SEQ ID NO: 61209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattagattctgccattgatttgggtttaggt

SEQ ID NO: 61210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattagccgaacggtctatgaagggcatccta

SEQ ID NO: 61211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattagcgcgcggaggtacgtaaggggatgtg

SEQ ID NO: 61212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaggtactgcgtcatccggtctcctgagt

SEQ ID NO: 61213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattaggtttgcacatggctagctaatagcat

SEQ ID NO: 61214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattagtcgacggtaaccaccgcagtgaatga

SEQ ID NO: 61215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattagtcggcaattgtatcgtagtgtgggga

SEQ ID NO: 61216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattagtgcctgcgtgcggcgttaatcatcta

SEQ ID NO: 61217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattataatatcgttgtggctaggtcctgtgt

SEQ ID NO: 61218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattatatgatcacccgggagcaattctcttc

SEQ ID NO: 61219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattatcatcctccgagctcgcacccgtatga

SEQ ID NO: 61220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattatccaattgcgattgcggaatttcaaag

SEQ ID NO: 61221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattatccagtagttcacctttttcaaagtta

SEQ ID NO: 61222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattatctggttgcacggttaccggtggtgtt

SEQ ID NO: 61223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattatgaaaatccgttactctctgctgttaa

SEQ ID NO: 61224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattatggaacagattggcttccatttttgcg

SEQ ID NO: 61225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattatttttgcgtggtggccggtcagtgttg

SEQ ID NO: 61226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcaatggcaaattgatgtgtggttccgtg

SEQ ID NO: 61227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcacaactctcgtttatttctcaggcccg

SEQ ID NO: 61228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcagacggcgggctcggttgacgaggtgg

SEQ ID NO: 61229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcagcttcttgcgccctcccgtcgatggt

SEQ ID NO: 61230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcagtacggtggtatcggcctctcatcgc

SEQ ID NO: 61231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcatgacgtgtgtcggcccaattagtcgc

SEQ ID NO: 61232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcatgtcgatgtaggcccttgtgttactc

SEQ ID NO: 61233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattccatcctttaccaaggcctttatcatat

SEQ ID NO: 61234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattccatgtgtctctataaatagggttttcc

SEQ ID NO: 61235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcccgttccagccgatcgagacgactggt

SEQ ID NO: 61236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattccctgtcagcatgtatacaggcatcttc

SEQ ID NO: 61237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattccgccggttgtggatccgtatcgcgacg

SEQ ID NO: 61238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattccggtcgcaattcccgcttcagtccaat

SEQ ID NO: 61239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcctagttcgagtcttttcgcagaaggca

SEQ ID NO: 61240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcctcgactctcatattcacacccgccca

SEQ ID NO: 61241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattccttttagcccggggggacaatcgacta

SEQ ID NO: 61242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgagaagttgggaagcggggttgcaagg

SEQ ID NO: 61243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgaggcgttgttcagttgggggaacaag

SEQ ID NO: 61244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgaggtttcggaagggacgcgtcgggat

SEQ ID NO: 61245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgatgcgtcaggtaaaatggcattttgt

SEQ ID NO: 61246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgcgccataccatttcggctaagtcaca

SEQ ID NO: 61247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgcggcgagatgacgggagcgttcgtgg

SEQ ID NO: 61248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcggggaaagaagctgtgaggacagaaca

SEQ ID NO: 61249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgggggctcctggcgaattctgcgtgcc

SEQ ID NO: 61250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgggtgcaaccggtttttcacctttggc

SEQ ID NO: 61251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgtgggccctctatgtagcgggtctaag

SEQ ID NO: 61252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcgtttatcacaccgtgacctgcagccat

SEQ ID NO: 61253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattctacccactcagcttatgatagtcgctc

SEQ ID NO: 61254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattctagcgccggtgaggagagttctgtgtt

SEQ ID NO: 61255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattctagctttacagttcctaggcttcggcg

SEQ ID NO: 61256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattctcaggggtaattgcgttgacatgcggg

SEQ ID NO: 61257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattctgtccaatcggtatacaaaaggtcggc

SEQ ID NO: 61258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattcttactaagccttgatcccgatcgcgcg

SEQ ID NO: 61259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgaactcgccctaacaatgatgtgggccc

SEQ ID NO: 61260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgaagcgggcagtcttcgacatactaggc

SEQ ID NO: 61261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgacaatgttggtagacctcacgtatccg

SEQ ID NO: 61262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgacacggttgagagagtcacctgttccg

SEQ ID NO: 61263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgacatcgtcggcggggagctcttcgtcg

SEQ ID NO: 61264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgaccagcagcggcactgtggtatggtta

SEQ ID NO: 61265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgacctcccctaccggacaggcggtcggt

SEQ ID NO: 61266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgacgagtatggggcggggcgtgggtgag

SEQ ID NO: 61267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgacgcgttgattatcccctcgattacca

SEQ ID NO: 61268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgagatttggagtttgtgatcgttcttga

SEQ ID NO: 61269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgagccaaacacagttgttcaggtccaac

SEQ ID NO: 61270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgagccggtacgaaaaccagggcgaattc

SEQ ID NO: 61271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgagtttcttcatgtcaccatactcgtgg

SEQ ID NO: 61272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgatacttcgcgcgtgaccagggagagga

SEQ ID NO: 61273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgatcagctcgaatggagtcccggttctg

SEQ ID NO: 61274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgatcgatgtagtttggcctgaagcaagg

SEQ ID NO: 61275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcaaattgaagattggcggggaattcct

SEQ ID NO: 61276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcaagacacaattctagatgtacgcgta

SEQ ID NO: 61277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgccagcctatgccgagtggctatccatc

SEQ ID NO: 61278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgccatacgttacaagagtacacaccgtt

SEQ ID NO: 61279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgccggatgatcggtggtctcggggatcg

SEQ ID NO: 61280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcgaattgtcgtcaagtcaggaggtaaa

SEQ ID NO: 61281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcgacgccggggaatgtggttgagccgg

SEQ ID NO: 61282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcggcttttgtgtccacctgccgacaga

SEQ ID NO: 61283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcgggatccgctcgcgtcgacattgtgc

SEQ ID NO: 61284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgcgggtcactatgtttagttcggtctcc

SEQ ID NO: 61285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgctaaggggttgtgctattgatcgaccg

SEQ ID NO: 61286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgctgtgttcaggtcgctcgttgtctatg

SEQ ID NO: 61287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggacactgcaccgggacattgacttgtc

SEQ ID NO: 61288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggacagcagccaaagagatctctgcagt

SEQ ID NO: 61289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggaggtttccgttaaattcggttgtcaa

SEQ ID NO: 61290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggatcgcttctttgttatgtagctcaga

SEQ ID NO: 61291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggatgcgcttcctgattgtccatccact

SEQ ID NO: 61292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggccatagcatctctttcactctatggt

SEQ ID NO: 61293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggctactggtgtaacttaagtgtttcgg

SEQ ID NO: 61294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgggccaaattggagggcgaatcgccaag

SEQ ID NO: 61295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgggcttccttgaggttcgtcttggggca

SEQ ID NO: 61296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggggaagtgcaaaaaatatgcttcgtgg

SEQ ID NO: 61297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggggacagtgcgaaatgtacgtgcaaag

SEQ ID NO: 61298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgggtgatagattacctattggttgcttc

SEQ ID NO: 61299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgggttttctctcatttctatagctactc

SEQ ID NO: 61300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggtccctatatatcggtttagtggaagt

SEQ ID NO: 61301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggtcgtgtgctgaggtagccgtgtcttg

SEQ ID NO: 61302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattggtttgcgaattacgttccaccgtccct

SEQ ID NO: 61303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtaatttatctcgtaaggtgggggtcca

SEQ ID NO: 61304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtggccagttttcccggttgtgacgtgc

SEQ ID NO: 61305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtggcgtcccgcatggtcagcgacaggt

SEQ ID NO: 61306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattgtgggtgatggtggggtcggtcaaacca

SEQ ID NO: 61307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttaagcttttactctggttattttgtttc

SEQ ID NO: 61308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttacactggcgagctagtaactttgacca

SEQ ID NO: 61309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttactacttccgcttagaggtgcgtgtgt

SEQ ID NO: 61310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttactccggttttaacgttagaaatggtt

SEQ ID NO: 61311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttacttaagtcgacccataaccatgctct

SEQ ID NO: 61312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttagaagagcaattccctcttcccctcgc

SEQ ID NO: 61313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttaggatgtcttgttcttttattcgctga

SEQ ID NO: 61314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttagtcatagttgtccacacatgctgcag

SEQ ID NO: 61315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttatcattccgcttattagggttgcgccg

SEQ ID NO: 61316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttatgttgcggaggttgggaaagatcggt

SEQ ID NO: 61317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttcaagcaattgaagcgcgcaaacgtctc

SEQ ID NO: 61318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttcaccgaagttgctgacgaccgtacacc

SEQ ID NO: 61319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttccccgggcttgcgtaacgcgatacggc

SEQ ID NO: 61320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttcccctacacgatcggcgggtgtctgtc

SEQ ID NO: 61321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttccgtgtacgttttgcattcttccggca

SEQ ID NO: 61322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttcgacgcacaacattattcccgtaattg

SEQ ID NO: 61323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttcgtccatccggcgtggataaagggaaa

SEQ ID NO: 61324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttctacgtgcaggggattctttatgtcgc

SEQ ID NO: 61325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttctgtattgcgctcatgattgaatccgg

SEQ ID NO: 61326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttcttttcagtggtagtatctagaggtcc

SEQ ID NO: 61327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgagcggtcaagttcgtacgtagccctg

SEQ ID NO: 61328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgatcccgcactactgtatagctactgg

SEQ ID NO: 61329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgccacgtgcgcgtcgactccagcttag

SEQ ID NO: 61330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgcggaagactacaggcgcaatagtaaa

SEQ ID NO: 61331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttggatactttcgttttgacgtcggacgg

SEQ ID NO: 61332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttggccgccacaaatctttttcctcgttt

SEQ ID NO: 61333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgggaaattctggttcggtgaagcgtct

SEQ ID NO: 61334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttggttgaatcagccgtacgcacacggtg

SEQ ID NO: 61335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgtatactggcggtcactatttcatcca

SEQ ID NO: 61336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttgtccggtgcgtacgacaggtttctcac

SEQ ID NO: 61337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttaacttgttggtaacatcgctgttcat

SEQ ID NO: 61338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttactaatgtgcaataaacgtggacaaa

SEQ ID NO: 61339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttagaggtgctgtacccttgttgatgcg

SEQ ID NO: 61340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttaggggaccaatatgcattcggtatgg

SEQ ID NO: 61341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttgacacactaattccgcgagatacttg

SEQ ID NO: 61342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttgcgttatcaacaacctgagctgaccg

SEQ ID NO: 61343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttttcctttcctgatattagtaacggttt

SEQ ID NO: 61344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tatttttcgtgctctaccgcagtggcgcggtt

SEQ ID NO: 61345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tattttttttatcgtggtagggggtaccgttt

SEQ ID NO: 61346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaaacaaccgttgccctacgatcgaaaca

SEQ ID NO: 61347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaaaggccatactggttggaacccgtatg

SEQ ID NO: 61348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaaattccggtcgcggggcgagaattgcg

SEQ ID NO: 61349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaacacccgtatacgctagattctcaagc

SEQ ID NO: 61350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaagcctacaaactcccaagcgattttag

SEQ ID NO: 61351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaatcttgtatgttagtgtgtttccactg

SEQ ID NO: 61352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacaagagcgtaggcggcagtgtagacgg

SEQ ID NO: 61353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacaccagctgcgctctgtaggacggccg

SEQ ID NO: 61354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacagagaatgctagcaatgaagctttgt

SEQ ID NO: 61355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacataggaagcgttactttttggctgac

SEQ ID NO: 61356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaccacggagtatagaaactgcctcatgg

SEQ ID NO: 61357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaccatcaatgggtccgctgtcgggttgc

SEQ ID NO: 61358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaccggtatcgattagggttggttcgtgg

SEQ ID NO: 61359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacgactggtcgcgctaaagtcttgttct

SEQ ID NO: 61360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacggagcaggagagggatagctcgtggg

SEQ ID NO: 61361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacggtaagtgggcgcgtgaactctttca

SEQ ID NO: 61362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacgtcacccagctgaggttgcgttggca

SEQ ID NO: 61363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacgtcagaacccacgctctagccttacc

SEQ ID NO: 61364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaacgtttagcatacgctcggcggtccgcg

SEQ ID NO: 61365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaactacgcgtcgtgaaccatccgctgcaa

SEQ ID NO: 61366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaactgcgctggctcatcaattagcgtcgg

SEQ ID NO: 61367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagcactaagagcgtgctcttgcctgctg

SEQ ID NO: 61368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagcccgagttgtgtccccgttctgtagt

SEQ ID NO: 61369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagcttagctgcgttgtgccagcattctg

SEQ ID NO: 61370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaggagtgtgtaccgcatttagccttgtt

SEQ ID NO: 61371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaggcgtcacgtttatatctggttgtgta

SEQ ID NO: 61372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagggattgtggagagaagcggttggttg

SEQ ID NO: 61373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagggcttctgttgggcacgcatttggcg

SEQ ID NO: 61374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaggggaatgcaccaggatctcttatttt

SEQ ID NO: 61375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagggtcagtaaaggtcatagcgcagggt

SEQ ID NO: 61376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaaggtgtgttaccctacccgagaaggacg

SEQ ID NO: 61377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagtcaacacgacaccctgtcctatctcg

SEQ ID NO: 61378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaagtgtgatctatggacgaacaccaagta

SEQ ID NO: 61379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaatacgccgagcgtttgtgttttggcgtc

SEQ ID NO: 61380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaatctccgcgtaactaccagaatctgtca

SEQ ID NO: 61381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaatgggggaagggtaacacagctttttgc

SEQ ID NO: 61382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaatgtacatgatgagctatgaacggctca

SEQ ID NO: 61383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaattacggacgggtatctgtcaattctgg

SEQ ID NO: 61384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaattcttcctttgcttttagctgttggga

SEQ ID NO: 61385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaattgaatttttttggaatcacgcatctt

SEQ ID NO: 61386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaattggtaatctcgtcaccgtcgctaaag

SEQ ID NO: 61387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacaccaattgtttcgggtcgggtcattcc

SEQ ID NO: 61388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacacctagaggtttgcgtagagggccgat

SEQ ID NO: 61389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacacggtatacggacggggtaccgactat

SEQ ID NO: 61390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacagacggtcggaatacgccctgcagact

SEQ ID NO: 61391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacagtaccgagtaactgcatatggttggt

SEQ ID NO: 61392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacagtcgcagacgcgcggtcatcgtgagg

SEQ ID NO: 61393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacagtttatttggccctctcgtaaggata

SEQ ID NO: 61394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacatcatcggttcagatacgctactctaa

SEQ ID NO: 61395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacatccctgtgtcagacttcattcactgc

SEQ ID NO: 61396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacatctcgagcaaccggctagtttcattg

SEQ ID NO: 61397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacatggcgaaattggtaacgcctgcggtg

SEQ ID NO: 61398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccagcggtacacatttgtatctgcgctt

SEQ ID NO: 61399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccatgaatgaataagccttcagtcgacc

SEQ ID NO: 61400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccatgtgtcggcatctgttgtgaattgg

SEQ ID NO: 61401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacccggcttcccttctgtcaacgctactg

SEQ ID NO: 61402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacccggggaaaagcggactttatatgggt

SEQ ID NO: 61403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccctctggtgggtaacgcgtcgggtgga

SEQ ID NO: 61404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccgactttcccgtatcccggcgcccgaa

SEQ ID NO: 61405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccgagagcacggtgagttaaggctagtg

SEQ ID NO: 61406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccgcaaggtgagctcggtgcgtatttgt

SEQ ID NO: 61407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccgcagagaggtgtaaggcatccatcgg

SEQ ID NO: 61408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccgcgcacgatcgtatacaactggccgc

SEQ ID NO: 61409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccgcgctgagcaggggtgttgcgggtgg

SEQ ID NO: 61410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccgcgtgacgagggcggtcggagtccgt

SEQ ID NO: 61411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccggagcagaaggggacgttaggatgag

SEQ ID NO: 61412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccggcattttatagcatcgtcttgtgag

SEQ ID NO: 61413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaccgtcggttgctctatcgacacttcaca

SEQ ID NO: 61414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacctatgacagtccttgaacgtgtagggg

SEQ ID NO: 61415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacctcgccctggcggaggaatcacgcaca

SEQ ID NO: 61416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacctgagctgtacattcttcgtcttcaag

SEQ ID NO: 61417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacctgctggggcgggtatttgttgcctag

SEQ ID NO: 61418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgaaataggtatgttctttccttatata

SEQ ID NO: 61419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgacacggccatgggtcctgttccttgg

SEQ ID NO: 61420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgacgtgatgctgatgacagaatgacgc

SEQ ID NO: 61421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgagagacatttccgttctcgccattgg

SEQ ID NO: 61422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgataactatgtcgccccattaccgatg

SEQ ID NO: 61423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgcccccctaccttcacaccgacttcac

SEQ ID NO: 61424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgccgtccctgtaatcgaattctcggga

SEQ ID NO: 61425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgcgatcatttgttcacagtgtcctgca

SEQ ID NO: 61426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgcgatgccaaaggctctgtgactaaac

SEQ ID NO: 61427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgcgcaacatagtcgtcagctctgggag

SEQ ID NO: 61428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgcttaccacgaacttgctttggttccc

SEQ ID NO: 61429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacggacatgcggccttgtatgactccgac

SEQ ID NO: 61430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgggcggtgggaaggcgcggaatcattc

SEQ ID NO: 61431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgggtcggctttcggtccatgttctgtg

SEQ ID NO: 61432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgtagggttttaatcaggcttcccccac

SEQ ID NO: 61433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgtatcagggggtagcgctggtaggtta

SEQ ID NO: 61434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgtcgcgatacatcatcatggtgagcat

SEQ ID NO: 61435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgtctgcgggagttttgccacatggctt

SEQ ID NO: 61436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacgttgactggcgggatgctccctgtgcc

SEQ ID NO: 61437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaactattttctcggtgtatgagctgaagcc

SEQ ID NO: 61438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaactcagggcagcccttaggtaaggcggtt

SEQ ID NO: 61439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaactcagttagcttcaatctcacaaatcgt

SEQ ID NO: 61440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaactcatcggccgcctcgtgcaagcgatgg

SEQ ID NO: 61441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaactcctgttcaagagctcagctatgtgac

SEQ ID NO: 61442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaactcggcgacatccaagagttgacgagtg

SEQ ID NO: 61443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaactgggcacgcgcggcacgatcggcacgg

SEQ ID NO: 61444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaactgtaaacattacctaaaacactatccg

SEQ ID NO: 61445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaactgtaggacgctgcgaccacacgctctt

SEQ ID NO: 61446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaactgtcaaggtagggacaaagggacgggc

SEQ ID NO: 61447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacttgctccgtggatggtctgatggttag

SEQ ID NO: 61448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaacttggggaagcaccgggttagccggatt

SEQ ID NO: 61449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagaactctcgtattcgggtgcacattccg

SEQ ID NO: 61450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagaaggttagacaactattaaaactggtg

SEQ ID NO: 61451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagaatagccatatgtttatgaatgacacg

SEQ ID NO: 61452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagacaaaggaagtgtgccagggtatcccg

SEQ ID NO: 61453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagacatgtaattcttccctctgtgtacta

SEQ ID NO: 61454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagacgccagcatcggccacgcttaccatg

SEQ ID NO: 61455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagactgttcacttgctaggcgtatcggtg

SEQ ID NO: 61456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagagggagcgtaattcttatatgtgtgcc

SEQ ID NO: 61457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagagtagacatatgtctccaacaagtacc

SEQ ID NO: 61458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagagtatacggcgtgggataggctatgag

SEQ ID NO: 61459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagattaccgtcaaaccgtcgaaggtgccg

SEQ ID NO: 61460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagcaatccgaaggctctccattttatcat

SEQ ID NO: 61461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagcatacatgttatactgatcgtctcgcc

SEQ ID NO: 61462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagcatgcatacggcctattttcgtcgcgc

SEQ ID NO: 61463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagccataagattttagacttgaacgttcg

SEQ ID NO: 61464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagccgttactgcctgtctgagggatcgcg

SEQ ID NO: 61465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagcggctatgttatcgtcaagatcgttcc

SEQ ID NO: 61466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggagccgtctatccgagcccttatcgag

SEQ ID NO: 61467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggatcacgcgttccacaggaggcaattt

SEQ ID NO: 61468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggcaagacaaggggcacggctagcgccg

SEQ ID NO: 61469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggcgtccacaatgcgtcaactcacacta

SEQ ID NO: 61470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggcgttgtgtggtttgtcgagcacgggg

SEQ ID NO: 61471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagggagacacgaatacggggcttagtcca

SEQ ID NO: 61472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagggagatggcgtccggaatggaacgtcg

SEQ ID NO: 61473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagggatcgtgattctcctcactggtgacg

SEQ ID NO: 61474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagggccttgacgatgcctttcgtcagtgt

SEQ ID NO: 61475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggggactccgcgcacagaccttatttcc

SEQ ID NO: 61476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggggttgtacacattaaaggaacttggt

SEQ ID NO: 61477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagggtaaaacccctttatgcggtatacca

SEQ ID NO: 61478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagggtgaggcgcttcatgtgattagtccg

SEQ ID NO: 61479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaaggtggtgggataaaccgagagccggccg

SEQ ID NO: 61480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtaaagctattagagatgtgttcggttc

SEQ ID NO: 61481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtactcagtacttccttgtcgatagtat

SEQ ID NO: 61482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtcacaccctgttccggcccgtatgcgc

SEQ ID NO: 61483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtcctcattaattcccactctcgtgtca

SEQ ID NO: 61484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtcgagccgggtgaaacgcccaacacgc

SEQ ID NO: 61485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtctgcgaacccccggacatcatgcgtg

SEQ ID NO: 61486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtgacaacgtcagtacggagtatcatat

SEQ ID NO: 61487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtgcccgactcgacttaataggctggcc

SEQ ID NO: 61488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtgctttagtatggtctgttgcaggctt

SEQ ID NO: 61489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtgtacgcaaggggcaagtaagatggtc

SEQ ID NO: 61490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagtgttagtttaaagtccgcgtgcatcga

SEQ ID NO: 61491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaagttggggatcagtactcgacgcagctga

SEQ ID NO: 61492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaataaagatgagtatgcgtggaatgtcgtt

SEQ ID NO: 61493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaataatcccctcgtccctgttatgcggatg

SEQ ID NO: 61494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaataatcgagtcctttattagcgactctcc

SEQ ID NO: 61495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatagctagcctgggtaaccgtcaatctga

SEQ ID NO: 61496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatagcttggcgggtctccctccttgtatc

SEQ ID NO: 61497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaataggagcgtgagttttagacggtcaggc

SEQ ID NO: 61498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaataggtcgtgtttgagtttcccttctacg

SEQ ID NO: 61499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatattcccttactcctgagctcgatgaag

SEQ ID NO: 61500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatcaacgattctgtgttgtactcgctggt

SEQ ID NO: 61501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatcacgtggtcatgagacgcgtggacccg

SEQ ID NO: 61502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatcagcggccacgtcttcgctactctttc

SEQ ID NO: 61503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatccctggtgtaaactggtcgattaacgt

SEQ ID NO: 61504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatccggtgctcccgcatcagtgatcaagg

SEQ ID NO: 61505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatccgtgcttgaactgaggctatgcttaa

SEQ ID NO: 61506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatcgacaccaaagtcgaatatgggccaat

SEQ ID NO: 61507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatcgcttcggttgcacgaacctttggaac

SEQ ID NO: 61508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatcgtagggaggtttagcccagtattgcg

SEQ ID NO: 61509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatcttccgcgattgggaataatatgggac

SEQ ID NO: 61510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatgaattgagctagggcgctgcgggcggt

SEQ ID NO: 61511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatgatcccgtgaatgacacctgtgacgcg

SEQ ID NO: 61512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatggaactctcaagcccaagttttgcgcg

SEQ ID NO: 61513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatggcgtgttatggacgaatttgctcggg

SEQ ID NO: 61514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatggctcgacacattatacgtttgcagtc

SEQ ID NO: 61515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatggttaagatgcctcggtttcgttgtgt

SEQ ID NO: 61516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatgttgcgcaagggcagactgtcagcttc

SEQ ID NO: 61517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatgttgtagtagaagccaagctaccgatt

SEQ ID NO: 61518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaattaaaataatcgtttgggaggttagggt

SEQ ID NO: 61519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaattaagcgctcattcggtcgatacagtgg

SEQ ID NO: 61520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaattgggggatcaaccaggctatagtaggc

SEQ ID NO: 61521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaatttattgtcagatttgactttcgggata

SEQ ID NO: 61522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaaacgcctctatgcttacctggtccagc

SEQ ID NO: 61523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaaagctaaaccaccattaggacatctcg

SEQ ID NO: 61524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaaagggccagctagaacaggcatcctaa

SEQ ID NO: 61525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaacacagcaggaacattaaagtttgaat

SEQ ID NO: 61526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaacacggcggacggatgctgctagcctg

SEQ ID NO: 61527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaactagctcggagggtggaggaaacatg

SEQ ID NO: 61528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaactatcgggttcacatcatacaatctt

SEQ ID NO: 61529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaactgccgtcttccgtatcagtccccca

SEQ ID NO: 61530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaacttatcatttcctggttttagcttgt

SEQ ID NO: 61531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaagacacaagcaaccatccgggtagtag

SEQ ID NO: 61532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaagatacaaagattcgccgttggatatg

SEQ ID NO: 61533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaaggaactggctaccgttgggcagctac

SEQ ID NO: 61534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaatcagtgaaaggcggcccgagttgagg

SEQ ID NO: 61535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaatgctcgccgtggggtttgtatcaagc

SEQ ID NO: 61536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaattaacttttcatccggaattcgttcg

SEQ ID NO: 61537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacaacatgaactcgaaccaaaaatgctg

SEQ ID NO: 61538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacaagcaaacttgacgatttctgtacgg

SEQ ID NO: 61539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacaagtcaccgggttgcagtcttgcacg

SEQ ID NO: 61540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacacgggaacaacggccaatgaggcgtc

SEQ ID NO: 61541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacacgtgagtagcaagacgcgtttcagc

SEQ ID NO: 61542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacagccacatgttgtaattttctcggaa

SEQ ID NO: 61543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacatcccggcgataccggtcgttacgct

SEQ ID NO: 61544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaccaggggtcgcagtatcgcacagatgg

SEQ ID NO: 61545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaccatcacggacatcatcagggaagctt

SEQ ID NO: 61546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacccagaggttgggaatgctgtggacga

SEQ ID NO: 61547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacccccgtgcctcactacgggacgcgtc

SEQ ID NO: 61548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacccgacgaaacttgcgaccttaggcga

SEQ ID NO: 61549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacccgtagaggccaattatgtccgcatt

SEQ ID NO: 61550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaccctctttcactcgttagcgtcgaggg

SEQ ID NO: 61551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacccttgcatccatacggttagacgtcg

SEQ ID NO: 61552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaccggatcgggatagcactcgcggtctc

SEQ ID NO: 61553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaccgtcccgctcccgatttcactgcggt

SEQ ID NO: 61554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacgagccatcacgcttcctgctctgtcc

SEQ ID NO: 61555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacgcccgtgttttctgtttgcggcgttt

SEQ ID NO: 61556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacgcgtctcgcttggaactgttcgacgg

SEQ ID NO: 61557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacgctttacgccttgaggtctacagctt

SEQ ID NO: 61558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacggagtaccccttgccgcagctcagca

SEQ ID NO: 61559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacggccgcaccataattcgacaaacccg

SEQ ID NO: 61560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacggcgaagtcagctggacgctagaagg

SEQ ID NO: 61561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacggcgattgagtgtgaaagtgcggccg

SEQ ID NO: 61562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacggcgtcggccagaaaggcatccgtca

SEQ ID NO: 61563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacgggatctaggtagctttccgggcggc

SEQ ID NO: 61564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacggtccgccatatcttacgccactgcc

SEQ ID NO: 61565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacacgttttgacgagtcacttctcgctaga

SEQ ID NO: 61566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacactattcgcttcaggttatcagctaatc

SEQ ID NO: 61567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacactcaaggtcactagacggtactgggat

SEQ ID NO: 61568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacactgatgctgtcattctgcgcgggtgag

SEQ ID NO: 61569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagacatagacttccgccactcggcgctg

SEQ ID NO: 61570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagaccggtccgtcctgaattcagatctg

SEQ ID NO: 61571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagacgaatgtgcttgtttcatgcttgtg

SEQ ID NO: 61572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagatcttgtcacgtgaggacttctgatt

SEQ ID NO: 61573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagatgtaggagtatctgccggagcgccc

SEQ ID NO: 61574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagcagggcgacgtacaacacatcagatc

SEQ ID NO: 61575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagccacctcagcgctcatagtggtgatc

SEQ ID NO: 61576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagcgctattcagaagaggtgagctattc

SEQ ID NO: 61577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagcgctctatagactgttgcgtgagtgg

SEQ ID NO: 61578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagcggaatggacatgctacacgatcgcg

SEQ ID NO: 61579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagcggctgtcaggtgttggcttccagtg

SEQ ID NO: 61580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagcgttttgcaaatctgtttcgccgtgt

SEQ ID NO: 61581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaggacttttccagttgcacgtcacggat

SEQ ID NO: 61582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacaggcatgatcacacaaggcttgagatgt

SEQ ID NO: 61583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagggaaggcgtctgtttttccgaccggg

SEQ ID NO: 61584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagggccaaaaagcgaatagtttatgagg

SEQ ID NO: 61585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagggtaagtcatgcgactaacagtccgc

SEQ ID NO: 61586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagtcagtcattactacagtctcaacccg

SEQ ID NO: 61587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagtccgcaagatcgtagttgagcctcat

SEQ ID NO: 61588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagtgcccggcccctcgtcgatttgtgaa

SEQ ID NO: 61589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacagttccttcattgaggtacttcagggtg

SEQ ID NO: 61590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacataaaatgcgataagtggtattcatttg

SEQ ID NO: 61591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacataagcgaagaagtaactctttccgtgg

SEQ ID NO: 61592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatacacggacgaactctccagcggactc

SEQ ID NO: 61593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatatagattttgatttaccgatgttgta

SEQ ID NO: 61594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatccggccgcctcttgctttgtgatggc

SEQ ID NO: 61595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatcgcacagatttagtgttaagcgggaa

SEQ ID NO: 61596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatcgcggaaagaaatcagacttcaccgg

SEQ ID NO: 61597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatgccgcgctctcaccccttacggtgtg

SEQ ID NO: 61598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatgcgacggcgtttgatcatgggtgggc

SEQ ID NO: 61599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatggacaaacacgtctaaggggtgaaag

SEQ ID NO: 61600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatggcagaggcatgaccactatccctat

SEQ ID NO: 61601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacatgtggatcacaattgtactaccctctg

SEQ ID NO: 61602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacattaacgtgtatgcagtaattcgggtgg

SEQ ID NO: 61603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacattatcgagcgagcgcttcgtttcgggc

SEQ ID NO: 61604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacattatgttactctgagaacggtcccttg

SEQ ID NO: 61605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacattggcctaacttgaggcggctagggca

SEQ ID NO: 61606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccaaaacctgtttttttgcacggttccgc

SEQ ID NO: 61607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccaaaacttttctttgcggagataattgg

SEQ ID NO: 61608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccaacgacaaccctaggtaattgtcagag

SEQ ID NO: 61609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccaagtacagcgcaccgtggatggggatg

SEQ ID NO: 61610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccaatactcgttctcgaaagacactgcct

SEQ ID NO: 61611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccacacggatggcacttgacgtagctcgg

SEQ ID NO: 61612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccacacggtccgggacagtagcatcctta

SEQ ID NO: 61613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccacaggcgatgttgtcatcaagtagtcc

SEQ ID NO: 61614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccaccgtatggatcgttggccactgctgg

SEQ ID NO: 61615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccacgaagcctcacgatgtggcacgatgc

SEQ ID NO: 61616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccacgccttctagcaccccgctacagaga

SEQ ID NO: 61617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccactatatatttgatggtaggctggttc

SEQ ID NO: 61618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccactccttcggctgggtagtttactatc

SEQ ID NO: 61619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccagacgagaaccttccatctgcggcgtg

SEQ ID NO: 61620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccagagaattaaaggaagagcggctcacg

SEQ ID NO: 61621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccagcatgctcgaagtactggatgcaagc

SEQ ID NO: 61622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccagcttaccgacagcgagggtgaattgg

SEQ ID NO: 61623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccaggctacaggattagacggtggtggga

SEQ ID NO: 61624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccagggctcaccgaccttgcatattgggc

SEQ ID NO: 61625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccagtactcccggtcgcgcatagtctctg

SEQ ID NO: 61626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccagtcatttggttagaattgatgaaccc

SEQ ID NO: 61627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccatcagctccggacaacatgaggcggcg

SEQ ID NO: 61628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccatccgtcggccgattgatactttaagt

SEQ ID NO: 61629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccatgtttcgcgctcgcgaagtgtcggtg

SEQ ID NO: 61630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccattaggcgtattcagctcgcctcacga

SEQ ID NO: 61631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccacatcgccggtccaagtttaagacgc

SEQ ID NO: 61632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccacggtatacccgttccggaggcttca

SEQ ID NO: 61633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccagtaagaaggcggcagttctggggcg

SEQ ID NO: 61634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccatatgacgtacgctggtcagagcgag

SEQ ID NO: 61635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccattgcttcgttcatatgcggtcggcg

SEQ ID NO: 61636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccccacgggcccctgtaacagcagtggcc

SEQ ID NO: 61637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccccactgttatgttctggattgtattct

SEQ ID NO: 61638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccccgacgttctaaaatattattgggccg

SEQ ID NO: 61639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccccgccaggacggttctcgttgacgtgg

SEQ ID NO: 61640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccccggtacgctgggtcgtgtgcaagcgc

SEQ ID NO: 61641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccctaactgtatattacgttcaagctct

SEQ ID NO: 61642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccctagacgatcgctacaggatagttct

SEQ ID NO: 61643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccgatcgcgaacttgatttgctggttgg

SEQ ID NO: 61644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccgatcgtgattaggagcggcgcgcatt

SEQ ID NO: 61645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccgcagccaaccgtacctgtgcctcgtg

SEQ ID NO: 61646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccgcgtacagtaatatcccggtctaata

SEQ ID NO: 61647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccgcttcggtcacaggagaggttcgcct

SEQ ID NO: 61648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccgtaaccacaagtctgacatttgtttt

SEQ ID NO: 61649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccgtcttgaccggagatacagcagctgg

SEQ ID NO: 61650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacccgtgcccctggtcggtggacgtgtttc

SEQ ID NO: 61651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccctaatgatacacgtatgctgggcccga

SEQ ID NO: 61652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccctacagtgttcaaggtcggttatcctt

SEQ ID NO: 61653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccctacgtgcctcgtttcagtacgacgga

SEQ ID NO: 61654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccctctacagtctcggtcccttcacctct

SEQ ID NO: 61655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccctgctggagctgttgggcttcaaaccg

SEQ ID NO: 61656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccctggcagtcttcaaacaggtttgcccg

SEQ ID NO: 61657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccctgggctttctgcgtacaatcgcggga

SEQ ID NO: 61658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgaacttgcctattgcgctctgtggcgt

SEQ ID NO: 61659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgacgtcacacgatggtataataacggg

SEQ ID NO: 61660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgactaggggccaaatgcgacagctttg

SEQ ID NO: 61661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgagcgattcccctctgggcgagtacgg

SEQ ID NO: 61662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgatgtacgtccgcgggatcggagtgga

SEQ ID NO: 61663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgcgtcagccttctgaaaacttggtcgc

SEQ ID NO: 61664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgctagctcttaattagcgttgttagcc

SEQ ID NO: 61665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccggacggtcgtcagccgggtagtcacga

SEQ ID NO: 61666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccggcaatcctactcctcgctcacttggc

SEQ ID NO: 61667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccggcagagggttgaccgagtccgggctt

SEQ ID NO: 61668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccggcgcacagcaggtgtgggtttcactc

SEQ ID NO: 61669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgggggagtgccgctggatcagtgccat

SEQ ID NO: 61670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgggtcttaacctagggggaggacggtt

SEQ ID NO: 61671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgggtggttagtagctcgggtcgtaagg

SEQ ID NO: 61672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccggtttcatggcccggtctgccaggtgc

SEQ ID NO: 61673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgtaggatcctcgattgtgttacggatt

SEQ ID NO: 61674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgtctgtagcccctaatttccgaccacg

SEQ ID NO: 61675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgtgccaatagccaaccataggatacat

SEQ ID NO: 61676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccgtgctgttggtgagcaaatgttcgatc

SEQ ID NO: 61677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctaacactacaccgacctgcacgacatc

SEQ ID NO: 61678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctcgagcgggcctacaatttgcatagct

SEQ ID NO: 61679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctcgataaatcgtatccttgcccaagcc

SEQ ID NO: 61680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctcgggtcagttgttatgtgcttgctgg

SEQ ID NO: 61681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctgatgacataaacgcaggctgtaagcc

SEQ ID NO: 61682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctgtacagtggtgagggcatcgtctctg

SEQ ID NO: 61683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctgttatgatctcggcctctgagattgt

SEQ ID NO: 61684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccttcactgatgattaggattgcccccgg

SEQ ID NO: 61685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccttcattgacccttgctacctgacggtg

SEQ ID NO: 61686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccttgcattacttcatttttcgacaggcc

SEQ ID NO: 61687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaccttgtacttcgccaaaccgctttgatcg

SEQ ID NO: 61688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacctttgccccattgagtgccttcattctt

SEQ ID NO: 61689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgaacagggacttggggccgtcaattgcc

SEQ ID NO: 61690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgaacatgtcttcgcgcagccttacaggg

SEQ ID NO: 61691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgaaccgatgcaatggcccattgatcacc

SEQ ID NO: 61692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgaagagtgaggttgtacgttctgcctct

SEQ ID NO: 61693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgaagcaccaatgttaagggacgtattgg

SEQ ID NO: 61694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgaatatctacatggtaggacggcggatc

SEQ ID NO: 61695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgacaaaccaacgtcgctctgatatctca

SEQ ID NO: 61696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgaccagactggcggggaacgtaacgccc

SEQ ID NO: 61697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgacctcacttgttccgtaccttgatgta

SEQ ID NO: 61698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgacgtacagagcaagtcaagggcatgcg

SEQ ID NO: 61699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgacgtcgaacgtcacatgaatctgcacc

SEQ ID NO: 61700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgacgtggatggtggcacctcgtgtgttg

SEQ ID NO: 61701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgacgtgtctcgggtcatgggggggcgca

SEQ ID NO: 61702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgacttattgtaccttcgttggccttgtt

SEQ ID NO: 61703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgacttgcccactgcgaatccgcacattc

SEQ ID NO: 61704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgagattcttctatacccttgcacgaata

SEQ ID NO: 61705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgaggagcacggctgtggcacagggtacc

SEQ ID NO: 61706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgaggtctacgggtccttccacgctcttc

SEQ ID NO: 61707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgaggtctagggcataccgtgtgtgcgcg

SEQ ID NO: 61708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgagtcggccagccaaaccgaagcgaatg

SEQ ID NO: 61709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgatctcccgccgttctcgcgctaggctt

SEQ ID NO: 61710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgatctgcgcccctaagtccttgatctcc

SEQ ID NO: 61711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgatggtcttaccctagttatgtttgcgc

SEQ ID NO: 61712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgatggttaaagaattattattgggcttt

SEQ ID NO: 61713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgatgttacgagcgtaagactagacgagg

SEQ ID NO: 61714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgattgtgcagacagcgaatgaggcttac

SEQ ID NO: 61715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgattgttttttactggtggtcttgactc

SEQ ID NO: 61716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcaaaagttagccagccgcgtcgtggta

SEQ ID NO: 61717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcaaaggctgctaactcatacggtctgg

SEQ ID NO: 61718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcaccccgcgaggtgggatcatggctcc

SEQ ID NO: 61719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcagagggggcgcattgaggtgttttgg

SEQ ID NO: 61720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcaggatgaccttccactccgcgtaagg

SEQ ID NO: 61721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcaggttatcccgcatctccgcggcaat

SEQ ID NO: 61722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcatcctggggttaaatctgctcttctg

SEQ ID NO: 61723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcatggtactcggcgcacgacacggtta

SEQ ID NO: 61724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcccattccctcgtacccaacggtgttt

SEQ ID NO: 61725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgccctcaacttggttactttgcataagc

SEQ ID NO: 61726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcctatggggattactaacacgtcagct

SEQ ID NO: 61727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcgagtaattatatccagttacagtaac

SEQ ID NO: 61728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcgccacagtactgaggcttcctgaatc

SEQ ID NO: 61729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcgtaaattccacgactaagtagattgg

SEQ ID NO: 61730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcgtactatctgttcagctggacgttcg

SEQ ID NO: 61731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcgtagtattcggaggttgtgtcttcgt

SEQ ID NO: 61732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcgtatacatcccgggaggggtacgaac

SEQ ID NO: 61733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgctacaccgcacgtgtaaccctcagctt

SEQ ID NO: 61734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgctatttacggtgaattcttgctcgcgt

SEQ ID NO: 61735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgctcacactactaatattgctgtcagcg

SEQ ID NO: 61736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgctccaattccctcgtcggtaccaatag

SEQ ID NO: 61737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgctccggctgctcgtattgcctgtttcg

SEQ ID NO: 61738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgctggctactgttgatatacgctcctct

SEQ ID NO: 61739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgctgtttctaaggtgaatacgtgtaatt

SEQ ID NO: 61740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcttacctatgccgcattatgcagccgt

SEQ ID NO: 61741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcttataaatcggttaggctcgccggtg

SEQ ID NO: 61742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgcttattgaacccggtaatatggtctcg

SEQ ID NO: 61743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgctttgaatcggtggtgatgttaggctt

SEQ ID NO: 61744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggaatatgctagaggatgccaggttctg

SEQ ID NO: 61745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggaatttgacagcaatcgcgcactggtt

SEQ ID NO: 61746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggacggggtttacgatttctataggcgc

SEQ ID NO: 61747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggactggggtactgtccgactcctcgaa

SEQ ID NO: 61748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggagtgttagggaaagctataaccgttg

SEQ ID NO: 61749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggataacacgaactgtcccccgttgttg

SEQ ID NO: 61750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggatatgaggccgctgcgtggggtagag

SEQ ID NO: 61751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggcagcatacaaacggatagttatgcgg

SEQ ID NO: 61752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggccacgtcagtaaacaaacgtacattc

SEQ ID NO: 61753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggccgtttggcacttgggtttgttttag

SEQ ID NO: 61754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggcctgcggggtaaacgacaggcaggca

SEQ ID NO: 61755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggcgcgcgaacagaggctatgcaggtgg

SEQ ID NO: 61756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggcggggttctgatgcggctgtcccggc

SEQ ID NO: 61757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggcgtcatctccttccaagtggatctac

SEQ ID NO: 61758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggctcaagcgtcgtcacatacagcgcac

SEQ ID NO: 61759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgggacgacgggttgagctccagtttgcg

SEQ ID NO: 61760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgggagccggggagttaggtgatggccct

SEQ ID NO: 61761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgggcacttcgtgttacgcgaatctgtca

SEQ ID NO: 61762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgggcgaggcgatcccagggggtatcgtg

SEQ ID NO: 61763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgggcgcaaagaataaacgtatctctgag

SEQ ID NO: 61764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgggctcgggaccgactcgctcaagggtt

SEQ ID NO: 61765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggggagtggattctggcctccttcgtca

SEQ ID NO: 61766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggggtacgtccgtgtttaggcccaaggg

SEQ ID NO: 61767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggggtgttcttggagcatccaaaaagca

SEQ ID NO: 61768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggtaggcaagggaggagcttccggaccg

SEQ ID NO: 61769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggtatggcagacttgcattgacaacatg

SEQ ID NO: 61770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggtcagcgaaggaagtatgatgtttcgg

SEQ ID NO: 61771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggtctgtacgagtcgttaaagatctgat

SEQ ID NO: 61772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggtgcggttgctgccacggggagtcaga

SEQ ID NO: 61773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggtgctgcggtgtgaacagctcacgctt

SEQ ID NO: 61774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggttaatctggttactaaatgtttccac

SEQ ID NO: 61775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggttcgtcagacgagtgttgttgcggat

SEQ ID NO: 61776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacggttgttgtctgttcgacctgcccaggc

SEQ ID NO: 61777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtaaatcggtgagctatcataaggttcg

SEQ ID NO: 61778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtaacctggtttgctctgtcactcctga

SEQ ID NO: 61779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtaacgcacatagttcggcacgtagctg

SEQ ID NO: 61780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtaccaattgtatccgacacggtgttta

SEQ ID NO: 61781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtatccaggcaccattctcgcacgcgcg

SEQ ID NO: 61782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtatgggtggccggatccgtgtttggcg

SEQ ID NO: 61783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtcacatccttaaacacttgtactaccg

SEQ ID NO: 61784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtccgcttctgcaggtgggcttcgggta

SEQ ID NO: 61785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtcgcagattacgggatgcaggctcggc

SEQ ID NO: 61786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtcgcgtcagcaatgatgatgactggaa

SEQ ID NO: 61787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtctttttatggttcaaagttagcggtc

SEQ ID NO: 61788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtgcacgaatcagggtgcggacaggcgc

SEQ ID NO: 61789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtgctccaccgagatcgaatatccacat

SEQ ID NO: 61790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtggaccctctgtggcagactcctcgtt

SEQ ID NO: 61791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtggcatcgactgtaggcatacgctgtt

SEQ ID NO: 61792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtgtcgggatttttttgaggtggtaacg

SEQ ID NO: 61793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgttaagacttcgtgcacatccagtcagg

SEQ ID NO: 61794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgttcggaatttcgatttttgcgctgcca

SEQ ID NO: 61795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgttctgatgtatgtttgtcacgcgtgta

SEQ ID NO: 61796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgtttcgtgtttttgctcgttaactgcgg

SEQ ID NO: 61797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgttttcaagtggggtggggtgtaaactg

SEQ ID NO: 61798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacgttttccgttcagtctgtagattccctc

SEQ ID NO: 61799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactaacaccacgatatcgtcgagttcggtt

SEQ ID NO: 61800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactaagctatgaagggcctcggtcagtgga

SEQ ID NO: 61801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactaatcgaaggtttgacctggctcgttgg

SEQ ID NO: 61802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactaattctcatcgggggagccaatgtttc

SEQ ID NO: 61803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactaccgcacaacggcgatgttattttcca

SEQ ID NO: 61804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactagcgacccgtcccatgttgttggggtt

SEQ ID NO: 61805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactatcgaggacggtctgtgtatcccattc

SEQ ID NO: 61806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcaaacacttccgcgcttccacttttta

SEQ ID NO: 61807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcagttcatttttgataattcggccagt

SEQ ID NO: 61808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcatgggccggctcggcacttccacgcg

SEQ ID NO: 61809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcatttcacagtttctccgaatatcgtg

SEQ ID NO: 61810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactccacttcgaacggtcatggcgtcgcac

SEQ ID NO: 61811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactccatcgcgagctctctgacctggcact

SEQ ID NO: 61812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcccgttggctacttcattcgtggtggt

SEQ ID NO: 61813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactccgggtacctcgacgctgtgattcctg

SEQ ID NO: 61814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcgacacctggatggccaaacgttgccg

SEQ ID NO: 61815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcgagcggaaaaaggcctacttgcgcat

SEQ ID NO: 61816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcgcgacttggttacctgggcggttcgc

SEQ ID NO: 61817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcggctaagtagatgtgcaataccaggg

SEQ ID NO: 61818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcggggcttatgcatcagtcttcatacg

SEQ ID NO: 61819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcgtatgttctcgtagttaagcgccagg

SEQ ID NO: 61820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcgtggagggccgttaaaccataagtgc

SEQ ID NO: 61821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactctgcacattaagagattcatcctcgtc

SEQ ID NO: 61822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactcttatgtattcatggaactcctctcgg

SEQ ID NO: 61823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgatagctactgtgtatgctagtagtgt

SEQ ID NO: 61824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgcagatggcgcggatgctaggcgggcg

SEQ ID NO: 61825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgcccatgaggtattacccgtccatcgt

SEQ ID NO: 61826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgcggcttttcggtgtgctcgcgcacgg

SEQ ID NO: 61827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgcgggttggttattgtcggggccaacg

SEQ ID NO: 61828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgctgacaagttttcgatgatgattcgg

SEQ ID NO: 61829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgctgttttgcaatcagtttgaaggggg

SEQ ID NO: 61830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactggaattcgacaaggtaccattactgta

SEQ ID NO: 61831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactggcaatactcgggttggggcgggtacg

SEQ ID NO: 61832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgggagagcgcggtccgattccttcgtg

SEQ ID NO: 61833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactggggcactgcgttattacgtgcgagat

SEQ ID NO: 61834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactggtgtgcgggattaaaggttgcgcctg

SEQ ID NO: 61835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactggttcgtggtaataccctgggctgtaa

SEQ ID NO: 61836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgtccgcctaggattggggctgtggttc

SEQ ID NO: 61837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactgtgtaggcccatccgcggtcatgcctt

SEQ ID NO: 61838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttaagcctgcagggagacacgctatttg

SEQ ID NO: 61839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttagagatagcagcggctataactcctt

SEQ ID NO: 61840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttatcgcggccatctagctaactttcgc

SEQ ID NO: 61841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttctcgctatatgcctatctcgctgacg

SEQ ID NO: 61842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttgccaggtaacgggatgcctgtcggtt

SEQ ID NO: 61843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttgggtaaacctggtccccgcgagtctt

SEQ ID NO: 61844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttgtagatttgtcgttttgccctgtagg

SEQ ID NO: 61845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactttaccatgatgtcggtttgaaacgtgt

SEQ ID NO: 61846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactttgcggatcatgttgggcggttagggg

SEQ ID NO: 61847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactttggagtcggcggaagagtggcactgt

SEQ ID NO: 61848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcacttttaagcctccctggtgtggtctgagc

SEQ ID NO: 61849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactttttattctcccgtctacaacaaaggc

SEQ ID NO: 61850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcactttttttagttaaaagatcagcggattt

SEQ ID NO: 61851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaaaagtggcgctaaccgtaagagcgatt

SEQ ID NO: 61852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaaaccggtccattatacggatagcctcg

SEQ ID NO: 61853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaaacgcggaccactacttgtttccagtt

SEQ ID NO: 61854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaaagaaatcggcagctgcgatgaccttg

SEQ ID NO: 61855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaaaggcccttcctgtccgccatatcggt

SEQ ID NO: 61856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaacaacgtgactgaatttggaatgaaac

SEQ ID NO: 61857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaactaccagtgcgtagataacttaggcg

SEQ ID NO: 61858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaactccatattgccacgccgcgatgacg

SEQ ID NO: 61859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaactgggggatgctattttgtccgcttg

SEQ ID NO: 61860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaagtatcagctaagcgagaagtatcgag

SEQ ID NO: 61861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacacatggtgcgtgaaggtgcctcggat

SEQ ID NO: 61862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacaccatcagttgtgccgtacaccgttc

SEQ ID NO: 61863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacaggcaagcgggtctcagtcagagacg

SEQ ID NO: 61864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacatgggtctccccaagtaagtcggagt

SEQ ID NO: 61865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacgctgggttttcagacagttgcttacg

SEQ ID NO: 61866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacggcagaccatgtcgagaatgtggtca

SEQ ID NO: 61867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacgggcgccggtaccgtgcttgatgccg

SEQ ID NO: 61868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagactgtagaacggtcgagcatccctcggt

SEQ ID NO: 61869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagactgtcttaggcggaccaccgacagacg

SEQ ID NO: 61870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagacttattcggttatgagccacgtagcgt

SEQ ID NO: 61871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagaaggcgttgtgaggactgaacactca

SEQ ID NO: 61872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagagccgtggcttcctcggaggaaatag

SEQ ID NO: 61873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagatgtgctgataaggtggaggtagtcg

SEQ ID NO: 61874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagcgaatacatttactgctgagtcccca

SEQ ID NO: 61875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagcgggttggcatatagaatcaagactg

SEQ ID NO: 61876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagctaaggaggactgatccgacttactg

SEQ ID NO: 61877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagctcagacttaaggaccccatcagcgc

SEQ ID NO: 61878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaggattggtccgagcacgtttactggtg

SEQ ID NO: 61879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagggatgctcggagttagttagtgcaat

SEQ ID NO: 61880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagggcagcaccggtactaggcttgtaag

SEQ ID NO: 61881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagaggtagtagggcgttgtattgggaatgg

SEQ ID NO: 61882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagtcaagtatctgttttggggaaagcct

SEQ ID NO: 61883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagtggcgatcccggccttacatcttttg

SEQ ID NO: 61884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagtgggattttaagtcatcggagttcga

SEQ ID NO: 61885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagagtgtgcgcggtcgacctaccctgctcg

SEQ ID NO: 61886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagatcactcggggctggcgccgcgtatgag

SEQ ID NO: 61887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagatcgactcgtcttgttatgacgggcgac

SEQ ID NO: 61888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagatcgagttggaccggtcaccggttggca

SEQ ID NO: 61889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagatctctacctggtaggactatcgccaac

SEQ ID NO: 61890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagatggcggcaaacaagtgcaggcttgacg

SEQ ID NO: 61891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagatggtggccccgtgcatgatggttaggc

SEQ ID NO: 61892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagatgtttgacacacgttttggcttcgagc

SEQ ID NO: 61893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagattaaggggcaccttgcacagttaataa

SEQ ID NO: 61894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagattctcatcagtatgcttcatttacgtt

SEQ ID NO: 61895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagattttgacaaatattagtcagctgcaat

SEQ ID NO: 61896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcaagctctgtgtcgaaccgctctacagg

SEQ ID NO: 61897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcaagctcttgaggtccttgcctgttgtg

SEQ ID NO: 61898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcacccacgggttgaaactgtggcatcgg

SEQ ID NO: 61899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcaccgacgacgtatcctacaagatcgtg

SEQ ID NO: 61900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcacgttctagtctgatgatggctagctt

SEQ ID NO: 61901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcactggccaaacgttctgagggcacggc

SEQ ID NO: 61902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcacttaagatgccggctagcatgacccg

SEQ ID NO: 61903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcactttccgcccttcaatgtggcgctgc

SEQ ID NO: 61904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcagaacggacgtgcaattcaactccaat

SEQ ID NO: 61905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcagagatcaaagcgcatagtgtgtacgg

SEQ ID NO: 61906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcagatcgggtattccagctactcacaga

SEQ ID NO: 61907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcagcgttataactgaagcaggtgatggg

SEQ ID NO: 61908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcagtagatataggttcacgtgcgcggcg

SEQ ID NO: 61909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcagtggaacgcggtgttaatggtgacgt

SEQ ID NO: 61910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcatcatcatttcggagtgaatggcccgg

SEQ ID NO: 61911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcatgcagccctggtaaacatggcgcgta

SEQ ID NO: 61912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcatgcagggcatatgtcggggcacagct

SEQ ID NO: 61913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcattcaggcacgcctcggcaccttgatg

SEQ ID NO: 61914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcattctaggaacgcagttttgtgagcgg

SEQ ID NO: 61915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccaaagccggcccgattgctcgtcgctg

SEQ ID NO: 61916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccaaggcgaggtggaaacccggcgatgc

SEQ ID NO: 61917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccaccgtcgtggaatagatatgaatccg

SEQ ID NO: 61918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccacctctagggtgcaatctgaggctta

SEQ ID NO: 61919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccacggaacgacaagtctcgggtgctct

SEQ ID NO: 61920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccaggaagtatgatacgcggccttctgt

SEQ ID NO: 61921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccatagcacttatggcgggggtttcctg

SEQ ID NO: 61922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccatatcgttgacgtgggagtgtgggcc

SEQ ID NO: 61923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccatggccagatcgtcatagggagccta

SEQ ID NO: 61924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcccacgtctagttctctggtcatggtcc

SEQ ID NO: 61925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccccggtctgacgaaacaaattggaatt

SEQ ID NO: 61926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcccggagaaaggatctcaagtgtgatgt

SEQ ID NO: 61927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccctcggttagatgtcctcacgtttttt

SEQ ID NO: 61928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagccggtaaagggttcttagctctttctcc

SEQ ID NO: 61929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcctacgaattagaatgcccgtatgatgc

SEQ ID NO: 61930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcctcgaatctggacgtcgcccatctctt

SEQ ID NO: 61931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcctggagtaggggtaaaacttcggcgtg

SEQ ID NO: 61932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgaagcggttatgccgcgtacatttggt

SEQ ID NO: 61933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgaagttcagcctaacgtcaactagacc

SEQ ID NO: 61934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgagcattcttgtgcagcccccggttgg

SEQ ID NO: 61935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgatccggggcgtctccggcatcccgtt

SEQ ID NO: 61936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgattggtgactcggcacgtctgggccg

SEQ ID NO: 61937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgcaaagtagttcccaatacaggagctt

SEQ ID NO: 61938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgcacccgaccataaacggaggtagttg

SEQ ID NO: 61939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgcacttatcacttttccctcgcgtcga

SEQ ID NO: 61940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgcaggctgttcaacggattatacgagc

SEQ ID NO: 61941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgccaaggccgacgagaggtagcacttt

SEQ ID NO: 61942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgccagggtgtagtaggtccaaagatgg

SEQ ID NO: 61943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgccctcggcttagggcccacctggtat

SEQ ID NO: 61944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgcgccatgagttgtggtcaggttagac

SEQ ID NO: 61945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgcggtataaagtgtgacgggaccattg

SEQ ID NO: 61946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcggattgtagggcggtgcgggtgtgacg

SEQ ID NO: 61947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcggcataccagattatcatctaatgggg

SEQ ID NO: 61948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcggcccctagctaacatcgccccacccc

SEQ ID NO: 61949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcggctaccatttggaggatcaatttggc

SEQ ID NO: 61950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgggcttcttccgtctttggctttcgtt

SEQ ID NO: 61951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcggttcgatacggttcttcagtctccga

SEQ ID NO: 61952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgtcagcccgtgaccaagggctgcgaag

SEQ ID NO: 61953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgtctgtgtcggggttggcagcgagagc

SEQ ID NO: 61954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgtgcgactacatactcatttaagccct

SEQ ID NO: 61955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgtggactccatatcccttgtactagta

SEQ ID NO: 61956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgtggtatggttgcttgagttatcggag

SEQ ID NO: 61957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgtggttcgagctgtaagtgaagggggg

SEQ ID NO: 61958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgtgttaatctcgcgtcctagaacaccc

SEQ ID NO: 61959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgttaggtgctggcgtttaatttacttg

SEQ ID NO: 61960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcgttttattttacttccttggattgcgc

SEQ ID NO: 61961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctaagtcatgtgaatacttaggggtcga

SEQ ID NO: 61962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctcagctgcggatcggtcattcattgct

SEQ ID NO: 61963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctcaggtcggggcctcgagtagggtcgt

SEQ ID NO: 61964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctccagggtgattcacacacggctttgc

SEQ ID NO: 61965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctcctttatgggaacctaatgcccgggc

SEQ ID NO: 61966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctcgaattcttttctaaacttgactgcg

SEQ ID NO: 61967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctcgttagacgtcagaccgtcgcatcgt

SEQ ID NO: 61968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctctatctgtcgttgtggcgcggcacgg

SEQ ID NO: 61969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctcttgatttctaatcgaatctgatgtg

SEQ ID NO: 61970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctgatccgtatttgcttagtgctcaatc

SEQ ID NO: 61971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctggagtaacaggctggataccggcgcc

SEQ ID NO: 61972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctggagtgggccgggcgtaccgagatta

SEQ ID NO: 61973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctggttagttttgtgtgagctgcgcaag

SEQ ID NO: 61974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctgtctgtcaaagttcgagataatcaac

SEQ ID NO: 61975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctgtgaaccacacccccttgctccttgt

SEQ ID NO: 61976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagctgtggcagtaaaccagcgatcgggcca

SEQ ID NO: 61977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcttaaatgggccacgaccaaggatcccg

SEQ ID NO: 61978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcttagtgggtcaacacctgcattatcga

SEQ ID NO: 61979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcttcaaattccgcgaatgtaccgcttat

SEQ ID NO: 61980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcttcgagccgaatgtggaattcggttgt

SEQ ID NO: 61981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagcttgaatctccgtcgtctttgccgtggg

SEQ ID NO: 61982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggaaacacgtcaggccggaggttacaggt

SEQ ID NO: 61983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggaaacacgtcgttgtctatttgctctgg

SEQ ID NO: 61984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggaagctgtccgcccagtgttagatgttc

SEQ ID NO: 61985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggaagtttttcgtttttggacacgtgcga

SEQ ID NO: 61986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggaccggtcgggcccacaaggacgcggcg

SEQ ID NO: 61987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggacctctggtgtttgtgcgttggtccgg

SEQ ID NO: 61988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggacgtctcaatgtagtgcattattggat

SEQ ID NO: 61989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggacgtgggctagtcgctgtttaactcgt

SEQ ID NO: 61990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggactcgcttgagcacgctcctctacgat

SEQ ID NO: 61991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggagctacactaacactccgtacatagcg

SEQ ID NO: 61992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggaggcccggctgattttgttgttctgca

SEQ ID NO: 61993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggagtgggtttctttcccagctttggttt

SEQ ID NO: 61994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggagttgccgggttatccctttcatcctc

SEQ ID NO: 61995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggataacccttattcatggatcatgggtt

SEQ ID NO: 61996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggataggttgcaagttgccttgaggagac

SEQ ID NO: 61997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggatagtctgaagaagttcgactccctac

SEQ ID NO: 61998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggatcacggcttgaggacgtcgtgttgtg

SEQ ID NO: 61999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggatctagacggtcagggtctggcatcgg

SEQ ID NO: 62000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggatctgctgttaagagggttgcactcgt

SEQ ID NO: 62001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggatgacgtgttgattcggagcttaatcc

SEQ ID NO: 62002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggatgggatagttaggaagtcggcaaagc

SEQ ID NO: 62003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggatggtattatcgccacttgccgttaac

SEQ ID NO: 62004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggatggtttcacttttgatgatgtcgttt

SEQ ID NO: 62005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggatgtttccgggcgtgggcagcagctaa

SEQ ID NO: 62006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcaaaacgtcgaatagcggtcggatgtg

SEQ ID NO: 62007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcaaaggcaggggagtatgtcacagcgg

SEQ ID NO: 62008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcaacaacatcttattttggatgttctg

SEQ ID NO: 62009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcaagccgtaagcagcgccatatgtagc

SEQ ID NO: 62010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcacggaaaccatccgttgtcgcccact

SEQ ID NO: 62011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcacttcgtcactcgggggtgaatatta

SEQ ID NO: 62012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcagtttcgtgcttgggcgtgctctttg

SEQ ID NO: 62013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcatagtaaacataattgatcgaatatt

SEQ ID NO: 62014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggccaccccgaggcatgaagttaacaaca

SEQ ID NO: 62015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcccgtagggggtcttgtttctgtctgg

SEQ ID NO: 62016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggccgccacgaccactattcacgcggtaa

SEQ ID NO: 62017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcctctcatctcgatcgggagtcaagat

SEQ ID NO: 62018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcctggatcccttcatgcccttttagat

SEQ ID NO: 62019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcgcctggcgataacggaaatctacctc

SEQ ID NO: 62020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcgcggtactttgtgattgctcctttgg

SEQ ID NO: 62021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcgggaatattctctcctgattgtctct

SEQ ID NO: 62022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcgggggggacaacgctaaatgcggaga

SEQ ID NO: 62023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcgtacgtacagacccagcgagcaaatg

SEQ ID NO: 62024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggctaaactggaaatcccgttagtagtcg

SEQ ID NO: 62025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggctcgaaagcggctaaaactcggactgc

SEQ ID NO: 62026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggctcgacggatcagggattcaggttcga

SEQ ID NO: 62027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggctcttttaaacgtacgcctaacttccg

SEQ ID NO: 62028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggctgggtggcagggtgatcgatgcgcat

SEQ ID NO: 62029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggcttggtatcggactcgcgcatccagag

SEQ ID NO: 62030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggacaaccatgcaggacttgcgtgtacg

SEQ ID NO: 62031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggacgccacaatagaacgtgcgcgtgcg

SEQ ID NO: 62032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggagaaggcggatggcctacgtgtgaca

SEQ ID NO: 62033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggagagcgtaaacgcatccactgtgttg

SEQ ID NO: 62034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggagcgcaacagtaacgggcaacgggcg

SEQ ID NO: 62035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggatgttaggccctcggggcgtcactcg

SEQ ID NO: 62036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggattgccttgcaactcactactcgtgg

SEQ ID NO: 62037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggcacgggacaggtcggcgactttgcac

SEQ ID NO: 62038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggcagaaagcgtgtcgtgagctcgaggg

SEQ ID NO: 62039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggccatcatacacagtacttgtccgcac

SEQ ID NO: 62040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggccattattaagcgcgggaattagccg

SEQ ID NO: 62041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggcgcaacacgcgtgttgggtcttcgac

SEQ ID NO: 62042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggcgctaggttggtcgggctcagtcaaa

SEQ ID NO: 62043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggcgtgacaccgcagggtctcgagcttt

SEQ ID NO: 62044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggctcgcaaccggtaggcagtgaggggt

SEQ ID NO: 62045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggatggccagggggagtgtggtcctgg

SEQ ID NO: 62046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggcggcgtacattcagggggcactatc

SEQ ID NO: 62047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggcgtggttctagtttcttcaacattg

SEQ ID NO: 62048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggggtaagtcatgttagtatagtcccg

SEQ ID NO: 62049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggtacgtgcttgggtgtccagcgcgcg

SEQ ID NO: 62050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggtatagcgaacactgctcagaaggcg

SEQ ID NO: 62051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggtcctcggcatctcgttttttcattg

SEQ ID NO: 62052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggtgtgaccatgaggccgtcccctgag

SEQ ID NO: 62053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggttgacgaatcatcgaagcactcggc

SEQ ID NO: 62054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggttgtattcattcgtatccgagtgtg

SEQ ID NO: 62055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggggttttactcgtttctgtctcgattta

SEQ ID NO: 62056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggtacccttaataaggtactatttacca

SEQ ID NO: 62057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggtatcgcgaggggccggcaatctcagg

SEQ ID NO: 62058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggtcggcttcctgggttacacctcatta

SEQ ID NO: 62059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggtctaggcgtctaacgaatcagcgggg

SEQ ID NO: 62060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggtgattacagtgtactgggggtggaag

SEQ ID NO: 62061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggtggcggcgctatgtttctttccggcg

SEQ ID NO: 62062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggtggggagttagttctaggtatgatcg

SEQ ID NO: 62063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagggttggtatagggttataggcggaggtg

SEQ ID NO: 62064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtaacgcttgcgctgtggcacggtgcta

SEQ ID NO: 62065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtaataatttttgagttacgtagaactt

SEQ ID NO: 62066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtataagagcgcgtagtagctagagtgt

SEQ ID NO: 62067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtcaccatcctagggaattatcccatgt

SEQ ID NO: 62068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtccctaagcctaccgcgcaataggaag

SEQ ID NO: 62069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtcggtctatgtttggctcgtcagcggt

SEQ ID NO: 62070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtgacgatgaggggccatggagcgcacc

SEQ ID NO: 62071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtgcgtaagcctcattgagttgccgcgt

SEQ ID NO: 62072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtggatgccttcttactcttgatgccgc

SEQ ID NO: 62073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtgggacgatcatggccgtttactgcgg

SEQ ID NO: 62074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtgggcaaggcaccgtatcagttcccgg

SEQ ID NO: 62075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtgtagaagcccgacgcagattccgggc

SEQ ID NO: 62076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtgtcattgggtgaattctgggccgtta

SEQ ID NO: 62077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtgtccttcccgtcgtgacttctgtgac

SEQ ID NO: 62078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggttagcgcacatggtggtaataaggaat

SEQ ID NO: 62079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggttagtgattggtccctagtctagtggg

SEQ ID NO: 62080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggttcggtatacggaggtgaggttcttgc

SEQ ID NO: 62081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggttgggtaacccggcccagttagctagg

SEQ ID NO: 62082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcaggtttctacagttagcgtcggggtttgca

SEQ ID NO: 62083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtaaagcgtagcaaacgttaggggatgac

SEQ ID NO: 62084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtaacttatctggaattctgatttattcc

SEQ ID NO: 62085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtaaggcgcgatacttattctgcttactt

SEQ ID NO: 62086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtaatcgccttaatgtaaaggatccccac

SEQ ID NO: 62087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtacgacattgcagtggccgtggttatat

SEQ ID NO: 62088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtacgccaccatttggccgtttggatgga

SEQ ID NO: 62089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtacggcaggaaacgcgcgggatgcaaag

SEQ ID NO: 62090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtagagcaattttactgttttatccgtgt

SEQ ID NO: 62091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtagcaaccttgcgaggatggggtttggg

SEQ ID NO: 62092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtagggatgcagtatggatttacggtgag

SEQ ID NO: 62093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtatggtgactacggtttcgttggctggt

SEQ ID NO: 62094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcaaggggtccggagtttgtgcacagtt

SEQ ID NO: 62095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcacaccgcgaggataggggcctaccct

SEQ ID NO: 62096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcagatgaggtcgccttctttactgaca

SEQ ID NO: 62097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcccgattcgatacgctcctactgccta

SEQ ID NO: 62098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcccggtgtggcggtaatgttttgtcct

SEQ ID NO: 62099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtccctcgggatgcgcatgtgtggtctcg

SEQ ID NO: 62100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtccgggcaggttggcgtcatgcagcatt

SEQ ID NO: 62101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcgcaccgtacatcattctcagtccgct

SEQ ID NO: 62102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcgggaagcgatctcagtcaggtgcagg

SEQ ID NO: 62103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcgtccggggattcacgtttggcgttgg

SEQ ID NO: 62104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtcgtgactgtgccggtggatcgtggtca

SEQ ID NO: 62105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtctaacagggattgagcaggtgtggacc

SEQ ID NO: 62106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtctggtccaaacaagctggcggtaagtg

SEQ ID NO: 62107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgaacatacccatagccggtgtatgtac

SEQ ID NO: 62108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgaggaagtttgctggatggtgaggaga

SEQ ID NO: 62109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgatttcatagatatactccaaatactc

SEQ ID NO: 62110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgccatagacgtttgtcgctgatttcgt

SEQ ID NO: 62111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgctgtcgaggacttaatatcgaagcgg

SEQ ID NO: 62112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtggaagagcctattacgtaatcctgtgg

SEQ ID NO: 62113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtggcgtgcgtttgaggcctgtacccgtc

SEQ ID NO: 62114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgggagcctggttccatagtaatggcgg

SEQ ID NO: 62115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtggggaagagatgttgtggatgtacggc

SEQ ID NO: 62116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgggggatccgggccgaaatgtttcttg

SEQ ID NO: 62117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtggggggcctacgattgcatatccataa

SEQ ID NO: 62118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtggtaagatcgttcacgcggtgatcagg

SEQ ID NO: 62119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgtaacaagactaattagcgctacgtcc

SEQ ID NO: 62120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgtacggtcatttatctacagcgccttg

SEQ ID NO: 62121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgtcagaagttatgtcggaaggccccga

SEQ ID NO: 62122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgtggtgccggggttgctgttattcgtg

SEQ ID NO: 62123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgtgtcagggagagttcacgtttgcggt

SEQ ID NO: 62124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtgttcgctcaaacctcatattgactacg

SEQ ID NO: 62125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttaacgtaagttggtgtcctcgccagtt

SEQ ID NO: 62126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttacgcgactacgaggcatccttacgca

SEQ ID NO: 62127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttactacagaatttcaaggcaggggaag

SEQ ID NO: 62128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttacttcccaaggttgcccggggttggg

SEQ ID NO: 62129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttattaatttaacttggtgaacgctgtg

SEQ ID NO: 62130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttcacccgcattgaatggaacggacagt

SEQ ID NO: 62131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttcagacagctatgccaggccttgtgga

SEQ ID NO: 62132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttcaggtagcccagttgcgcgatcaatt

SEQ ID NO: 62133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttctcgtatatagatgtaccgggtgtcg

SEQ ID NO: 62134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttctttgagagtagactcaaatcgtagg

SEQ ID NO: 62135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttgaacgtatcacttacaccggatttct

SEQ ID NO: 62136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtttactgaagggctacttgagcggtcac

SEQ ID NO: 62137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagtttagagactgccttgtgcccccattgc

SEQ ID NO: 62138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttttatacaacactcgatctctccagga

SEQ ID NO: 62139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttttatggttggccgattaggcgatcgg

SEQ ID NO: 62140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcagttttgctggtaaccgattggacattaca

SEQ ID NO: 62141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataacagctcccggtgactagccagaattc

SEQ ID NO: 62142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataaccgcatactagagttccggcgtcagt

SEQ ID NO: 62143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataagaaaggcatacacctgttattattgg

SEQ ID NO: 62144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataagtattcgcgataagatttaagtaggt

SEQ ID NO: 62145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataagtcaaccgacggcatagggtttagca

SEQ ID NO: 62146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataatcccgcccctgtgagacacgtttgcg

SEQ ID NO: 62147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataatcgacttgccaccgtgttgaccagcc

SEQ ID NO: 62148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataatgtagttggcgggaccacaatgggta

SEQ ID NO: 62149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatacagcagccgcatgaatcgtacatcttc

SEQ ID NO: 62150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatacaggacagtctgccctactcgtagcaa

SEQ ID NO: 62151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatacaggcgtaggcaacgttactcggctgc

SEQ ID NO: 62152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatacatcaggttctagcccgtgtgttgccc

SEQ ID NO: 62153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatacccgccagcgtggttcaaacgtacggg

SEQ ID NO: 62154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataccttgaaagcgctccgattggcatgcg

SEQ ID NO: 62155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatacgagtacatattgtctaataggtgcca

SEQ ID NO: 62156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatactcgctcggttcagcaggtgagccccg

SEQ ID NO: 62157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatacttcttgtccctcggcctctgtgcgca

SEQ ID NO: 62158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagacgaacactcgtgatctttgccgggc

SEQ ID NO: 62159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagagtcctggtggttggacgatgcccat

SEQ ID NO: 62160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagcatgaccggtcttctcgcttggactc

SEQ ID NO: 62161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagccacatctgggataacgagaccgttg

SEQ ID NO: 62162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagcttctaagtaagcctggagcagttga

SEQ ID NO: 62163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagctttgaacatctgtaggcggtcattc

SEQ ID NO: 62164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataggaccggttttcccttgtgtttaacgc

SEQ ID NO: 62165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataggattgagtgggtgcgatgagcgcttg

SEQ ID NO: 62166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataggctttggtttcgtgtgttctggtccg

SEQ ID NO: 62167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataggggcggtaactcgcgcacgcgatctg

SEQ ID NO: 62168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagggtggactccacgctgtcagagaatg

SEQ ID NO: 62169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcataggtatgcagcaagtcttgttaggagta

SEQ ID NO: 62170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagtcagggacgcgaatcgcggcttatca

SEQ ID NO: 62171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagtccagtgtggtcatgggcttcgggcc

SEQ ID NO: 62172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagtccgcgtgagctggccggttacacgg

SEQ ID NO: 62173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatagtgcatttaagatccttgtattattag

SEQ ID NO: 62174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatatacaggatataggttgttagtttgtta

SEQ ID NO: 62175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatatcctaagcagagcaccccggacgtggg

SEQ ID NO: 62176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatatgcctagttgatgctgcccagcctgcc

SEQ ID NO: 62177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatatgctagatgagttcagtataggctgcg

SEQ ID NO: 62178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatatggagagaatgcaatcaatccctcgag

SEQ ID NO: 62179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatatgggatacggtgagcggttcgagtggt

SEQ ID NO: 62180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatatgtcttgcggaccagcggcattttctg

SEQ ID NO: 62181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatattccggccttttgaagtctcacactat

SEQ ID NO: 62182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcaagatcatgcgcggacacgaattcagg

SEQ ID NO: 62183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcacagcagataggtgcatacttccctta

SEQ ID NO: 62184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcacaggtggagcgtcgttttcttccggc

SEQ ID NO: 62185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcaccgagataagaccatgtttctgggat

SEQ ID NO: 62186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcagaatcgtacggtgattccggacatgt

SEQ ID NO: 62187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcaggattcaattacagggtacaagtaat

SEQ ID NO: 62188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcatggtcgagcactggtcttgccggttt

SEQ ID NO: 62189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcattttcgccaccagcttggctcgaagg

SEQ ID NO: 62190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccaaagtgatagatcttcccggattgct

SEQ ID NO: 62191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccaagttctgtcactgtattagggttac

SEQ ID NO: 62192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccacacgtgatctgccatcggttgctca

SEQ ID NO: 62193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccactaactacgggtgccgttctcgacc

SEQ ID NO: 62194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccactccaaatgacgtgcaattaagtca

SEQ ID NO: 62195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccaggggcacgcgtgtatccttcgcctt

SEQ ID NO: 62196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccatctacattacgtggctgctgggagt

SEQ ID NO: 62197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccatgccattgtcaactttactttagcc

SEQ ID NO: 62198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcccacccgctggtggggcttggagcacg

SEQ ID NO: 62199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcccattttatccgtggattagcggtggg

SEQ ID NO: 62200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcccctcttgggcttgggcagtctatgtt

SEQ ID NO: 62201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcccgttcatgcctgtgcgtcaacgatag

SEQ ID NO: 62202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcccttcgaaacccagctgtgccggttac

SEQ ID NO: 62203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccggctcttcgatgatttctggtccctg

SEQ ID NO: 62204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccggtcgttcttgttaacggcagccatg

SEQ ID NO: 62205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatccgtcatctaaccacttttgtgggccga

SEQ ID NO: 62206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcctgctaattagtatgcggactcatttc

SEQ ID NO: 62207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgaaaagtgggattcaagggggaattcg

SEQ ID NO: 62208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgaaacagggcccgtaatgggttgcatt

SEQ ID NO: 62209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgactgctttctcctcacttcctcatcc

SEQ ID NO: 62210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgagaccgtgaaggactatgtcgtacga

SEQ ID NO: 62211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgcactccacgttaggtaaccgtccttg

SEQ ID NO: 62212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgcaggatccctcccagaccttgccgct

SEQ ID NO: 62213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgccgagtatatgttggagaccagccgt

SEQ ID NO: 62214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgccgcacgtgttgccctgtcagatgag

SEQ ID NO: 62215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgcgagtacggcttgtcgctaattatcg

SEQ ID NO: 62216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgcggggcccacttggctctgtggggag

SEQ ID NO: 62217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgcggtatggcctgggcacggcggtgtg

SEQ ID NO: 62218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgcttctgcctgtctttacgcagcctcg

SEQ ID NO: 62219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcggacgaacgcacagcactcgggtgcca

SEQ ID NO: 62220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcggaggactgtgcaagacccaacattat

SEQ ID NO: 62221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcggatgtatcaggctagcatctccgtac

SEQ ID NO: 62222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcggcttcgatcggagtaggcctggcgcg

SEQ ID NO: 62223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgggagcgggcatagtaacttatgcata

SEQ ID NO: 62224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgggcgcagctgtcaggactatgaacaa

SEQ ID NO: 62225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcggtcgggcacggagttagctgctttca

SEQ ID NO: 62226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgtcaagcttcactccacggttctcttc

SEQ ID NO: 62227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgtctgctaccctcaatagcgttcggag

SEQ ID NO: 62228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgtgcatttcatgggttgtacgctggta

SEQ ID NO: 62229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgtgtatgaacgcggtctgtgtgcagag

SEQ ID NO: 62230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcgttcagatggtacattcactgtcatag

SEQ ID NO: 62231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatctaactacgactagaaacacaacgtttt

SEQ ID NO: 62232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatctaaggcggacaatggcacgcgtgctag

SEQ ID NO: 62233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatctcggttacctgcgcctgggtgactggc

SEQ ID NO: 62234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatctctcatttctatagatcaggaacgatc

SEQ ID NO: 62235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatctgccggttgcttgtattttcgggttga

SEQ ID NO: 62236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatcttgcgaggagtgatggccggggaaatg

SEQ ID NO: 62237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaaactccagcaatccttcgcgcttgta

SEQ ID NO: 62238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaagttccgcacagatacgagcgccaac

SEQ ID NO: 62239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaattgattcattaagttagccataccc

SEQ ID NO: 62240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaccacggttaggcgggtttattagcta

SEQ ID NO: 62241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaccttcaccgggggacgcgtcgagatg

SEQ ID NO: 62242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaggagcagtactcaacaacgcagtacg

SEQ ID NO: 62243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaggcaatgtgactagaccggaccatga

SEQ ID NO: 62244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaggctccacgtgtgtggtcacttggat

SEQ ID NO: 62245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgaggtgattgactaggcacccggtcttc

SEQ ID NO: 62246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgagtgtccaaccaagctgcggatgcgag

SEQ ID NO: 62247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgatcccagaggtcaggattagttacctg

SEQ ID NO: 62248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgatccgtcatagaaacggggggtggcac

SEQ ID NO: 62249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgatcgtgggtactataggttcctaatcc

SEQ ID NO: 62250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcacaactgcatcgccctacggtaaagg

SEQ ID NO: 62251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcacaaggtttaacaggcccatttagcg

SEQ ID NO: 62252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcacagcgttacggttaaaaaagcccgc

SEQ ID NO: 62253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcaccatattgccgtttcgctattgcca

SEQ ID NO: 62254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcagagtctcggggtgtggtggccccgt

SEQ ID NO: 62255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcagtcctccttcccacacagcccggtc

SEQ ID NO: 62256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcatggaggttgatcgactgggcgcctg

SEQ ID NO: 62257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgccagggtgggttaagttgttagtctgg

SEQ ID NO: 62258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcccaaatgcgaatgtctacctcgtaac

SEQ ID NO: 62259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcccttcgactagggaaattattgctga

SEQ ID NO: 62260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgccggacagatggattggcgtgggtgtg

SEQ ID NO: 62261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgccgtcctatggtcaatgtgccgcgccg

SEQ ID NO: 62262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcctgccgcactcgacataatcaaattt

SEQ ID NO: 62263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcgaccaatggaaggatactaactctgt

SEQ ID NO: 62264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcgcaccaaacggacgtcaatgcggggt

SEQ ID NO: 62265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcgcaggtgggaatatccagttttttga

SEQ ID NO: 62266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcgccacttatgcattctgggcagcaga

SEQ ID NO: 62267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcggagggcagctcgatgcgtatcatgt

SEQ ID NO: 62268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcgggcaggaggttcatgcttgagatga

SEQ ID NO: 62269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcggtgccctgcagtcggcgcgcttgcg

SEQ ID NO: 62270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcggttttggtgacgctattgatggaat

SEQ ID NO: 62271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcgtctgctgtgggagcgtcacaggtgg

SEQ ID NO: 62272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcgtgatgctccagatcggcagcaatat

SEQ ID NO: 62273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcgttgcacattagtgcctcttcgtcgc

SEQ ID NO: 62274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgctaaattgggtatcgcaccttcagcgt

SEQ ID NO: 62275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgctcgtcgaaaacagcaggtgtagtact

SEQ ID NO: 62276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgcttggtcgtgttcgggaatactaggcg

SEQ ID NO: 62277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggaagcggcacggtcggatcgggggctg

SEQ ID NO: 62278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggactagtcttcatgtcgacggccctcg

SEQ ID NO: 62279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggagatcacctagcagctgtcgcggaat

SEQ ID NO: 62280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggatgttggagttgtttcatggcggctc

SEQ ID NO: 62281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggccgcgggttgccgggtccatagcagc

SEQ ID NO: 62282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggccggcacgctttggttgttacccgaa

SEQ ID NO: 62283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggcgacgtacttagatggtcttggttac

SEQ ID NO: 62284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggcgagggggtctagaccgcgttgcgtg

SEQ ID NO: 62285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgggaagattccgaggcatcagctgatcc

SEQ ID NO: 62286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgggacggcgattatcggcacacggatta

SEQ ID NO: 62287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgggaggtctcgtcgttctactggctctc

SEQ ID NO: 62288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgggcacactgaaggagttcggtgggggt

SEQ ID NO: 62289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgggccatttaaacttagcctgtggtgaa

SEQ ID NO: 62290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgggcgtactggtttataagcgctccttg

SEQ ID NO: 62291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggggcgagcattgatgagtttatcggtc

SEQ ID NO: 62292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggggtaaggtatcgaagaggccgcgtag

SEQ ID NO: 62293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgggtgaacttgcatgcatcattgatggc

SEQ ID NO: 62294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggtccatgatgggctacgtcgggggtgt

SEQ ID NO: 62295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggtcggattggccgttcgaaattcactt

SEQ ID NO: 62296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggtgcaacagttattcgacggggctctt

SEQ ID NO: 62297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggtgtcatacccaggggcgatttataac

SEQ ID NO: 62298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatggttctgcactccctttctcggcatccc

SEQ ID NO: 62299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtaatcgacgaaacgtcctggcaaataa

SEQ ID NO: 62300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtacagactctctactttgggtagcaac

SEQ ID NO: 62301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtcctgaacttttgttactgagcacccc

SEQ ID NO: 62302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtccttttctgttaggtgcgtgcgtaca

SEQ ID NO: 62303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtcgctaaagaggcaagcgtgcggggtc

SEQ ID NO: 62304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtctgatgccggtacagtttcactattg

SEQ ID NO: 62305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtcttagttcagggatgtatggagtcgt

SEQ ID NO: 62306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtgaacaaggcgtctacagataggggtc

SEQ ID NO: 62307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtgcaaaccagtggtccggcgtattgat

SEQ ID NO: 62308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtgccatcgtaatcgcgactccgcttcg

SEQ ID NO: 62309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtggctgctaccatgtgtggtcccgggc

SEQ ID NO: 62310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtgggcttgggggaattcactttacaag

SEQ ID NO: 62311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtgtgtgccgcaaacggtacgagtccga

SEQ ID NO: 62312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatgtttgtacgcgtttcgacacatcttctt

SEQ ID NO: 62313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattaaagcaggcgctgaacggggacggggg

SEQ ID NO: 62314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattaagttctggttattactcgttagctca

SEQ ID NO: 62315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattaatagacaagcgtcagggcgtcgatca

SEQ ID NO: 62316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattaccaatttattgcctccgtgcgcccca

SEQ ID NO: 62317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattacccttgggggtataggcgtgccaata

SEQ ID NO: 62318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattacgctcgccctccttgcatttcaatca

SEQ ID NO: 62319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattacggtcacaaaggttgccatttccgcg

SEQ ID NO: 62320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattagaaaatgcgtggttatttccagcggg

SEQ ID NO: 62321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattattttgttcgtgcctttgtaagtgggg

SEQ ID NO: 62322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattcacgcgtgggggtagtagtgtttatgg

SEQ ID NO: 62323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattcactctggcaggattcctagactcgga

SEQ ID NO: 62324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattccctctggtcaggaacatgggcagcac

SEQ ID NO: 62325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattccggatgggtatgcacacgacgaaggt

SEQ ID NO: 62326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattcctggtgcaatagcgtttgtccaggac

SEQ ID NO: 62327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattccttctcagtttcatccagaacgagtg

SEQ ID NO: 62328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattcgggggctgggtaaaggtggctaccgc

SEQ ID NO: 62329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgaaaacgaggtgttacatagcggattc

SEQ ID NO: 62330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgaatgggttagaggttcttctggggtt

SEQ ID NO: 62331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgaggccagtatcatgttaacgtatcgg

SEQ ID NO: 62332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgatcagggagacattgagacatagccc

SEQ ID NO: 62333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgcacttttttcccttttactctattat

SEQ ID NO: 62334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgccggaccacatacggagggtatcttt

SEQ ID NO: 62335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgcgttctgttccaggccctggtcaacg

SEQ ID NO: 62336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattggaggtttacttaggctcgcacacgat

SEQ ID NO: 62337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattggcctggacccggaacggcatggctgc

SEQ ID NO: 62338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgggagggctgcaaggtggcgtgtttct

SEQ ID NO: 62339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattggtcacgacattttattccaagggggg

SEQ ID NO: 62340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattggtttaggcacacgggatttatttgga

SEQ ID NO: 62341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgtactcaccacgtaagtaacagcctgg

SEQ ID NO: 62342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgtagcgaataaagaaggtcccgacgtt

SEQ ID NO: 62343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgtcacacgcccacccgtcaattgatga

SEQ ID NO: 62344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgtggtcctttgaatgtgcggtaaacga

SEQ ID NO: 62345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgttcgtattctatgtggttcttgttta

SEQ ID NO: 62346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattgtttgaagtgggtactagatgtgatgc

SEQ ID NO: 62347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttaccgtaaaagtaacatataggggcgg

SEQ ID NO: 62348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttagctgtgccatagactctcaggtcct

SEQ ID NO: 62349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttaggccacatataaacggaggtgctcg

SEQ ID NO: 62350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttagttacagatccgtaaaaggggtcga

SEQ ID NO: 62351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttcagagagtgcgttatgtggcggacct

SEQ ID NO: 62352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttgaataccattgccgattcacagcgag

SEQ ID NO: 62353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttgacttgttgaagagggacgcatagcg

SEQ ID NO: 62354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttgagattgtgctcttacacttacgcct

SEQ ID NO: 62355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttgagctgtagaagatttggctagagcc

SEQ ID NO: 62356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttgccgggggttcaatggtagcagacgt

SEQ ID NO: 62357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcatttgtggttggtttctcgaagaggccagg

SEQ ID NO: 62358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcattttcttattcgggcggtgggctgtcgcc

SEQ ID NO: 62359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaacccacagcgttcgtctggttttgccg

SEQ ID NO: 62360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaacgtgaggcactatgcgcgtagaggtt

SEQ ID NO: 62361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaagacccgcgttcatcccagatcagttt

SEQ ID NO: 62362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaagggggttcatccgcgtccccgggttt

SEQ ID NO: 62363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaaggtaattagccaaaattgaacgacct

SEQ ID NO: 62364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaataccagtatgcggcgcgttccacgag

SEQ ID NO: 62365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaatatcggagtgtttgtagcaaagggcc

SEQ ID NO: 62366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaatcacggaatccttttgcacggggcgg

SEQ ID NO: 62367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaatgctcaggctcaacatggccggggtt

SEQ ID NO: 62368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaatgggacgggtcgatgggggaaggcat

SEQ ID NO: 62369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaatgtggaggcagcggtcaaggcaaccg

SEQ ID NO: 62370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaattacgctcggtcgttactgggattta

SEQ ID NO: 62371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaacaacgaccagactcaccatcgcgatgc

SEQ ID NO: 62372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaacagcgtgcgacgggatatccgatgtga

SEQ ID NO: 62373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaacaggtatcgtaccgtcctgttcaagcg

SEQ ID NO: 62374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaacccatcgtgcgggaataaggacgcatc

SEQ ID NO: 62375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaccgagcaggtgtggcagcgccctatgg

SEQ ID NO: 62376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaacgcagcgcactttgccggttgagtgtc

SEQ ID NO: 62377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaacggcgtatctcggtattcttcgtggat

SEQ ID NO: 62378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaacgttgtcaaacacgtgggccccgttgt

SEQ ID NO: 62379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaactaggggcgtgtacgaagcaggatcgc

SEQ ID NO: 62380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaactatttcgattctatctaattccttaa

SEQ ID NO: 62381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaactgcgtatgtatgatcgcgggatctgg

SEQ ID NO: 62382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaactgtctccgaacctgttgcattctgtg

SEQ ID NO: 62383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaacttgttaggctgttttatgttgtactg

SEQ ID NO: 62384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaagccgtgatgcccgaaaatggcggaccg

SEQ ID NO: 62385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaagcgacggcggcgaacagtggtgtcctc

SEQ ID NO: 62386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaagctccgggcttcactcccgcctgcctg

SEQ ID NO: 62387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaggaaatgccacgggagcgacccttgga

SEQ ID NO: 62388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaggacgaccctgcatcctcgttcccgtt

SEQ ID NO: 62389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaggcatttcagtcaactagttattctcg

SEQ ID NO: 62390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaggcgtgtagggccgcgtgcgatttgat

SEQ ID NO: 62391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaagggcattgggggtacgttgggctacgg

SEQ ID NO: 62392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaagggtgcgggtaccgtctattccagcga

SEQ ID NO: 62393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaggtaacgctccttttcgaagagtcttg

SEQ ID NO: 62394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaaggttgtttaacggttcactcagcatgc

SEQ ID NO: 62395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaagtccattgggcttactaaacggccgtc

SEQ ID NO: 62396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaagtttgtgtgggatttatccgcatgacg

SEQ ID NO: 62397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatagaggggaactctgtatgcatatgct

SEQ ID NO: 62398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatagatttgtacggtcaaaacgcgtgga

SEQ ID NO: 62399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatcaacttaacgtccgtgctctgaagtg

SEQ ID NO: 62400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatcccacattttgatctcggtttaccat

SEQ ID NO: 62401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatccgactgcccttgttctaagcctaca

SEQ ID NO: 62402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatccgcctggcagggtcgataaattcat

SEQ ID NO: 62403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatcgcgtgagatctcgttcaatctggtg

SEQ ID NO: 62404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatcgttaacggtcaaccgcacacgttgc

SEQ ID NO: 62405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatcttagaagtcgatgataaggtataat

SEQ ID NO: 62406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatgaagcatccaagtccttttcatctat

SEQ ID NO: 62407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatgaggctagaggcttgcagcgatcacc

SEQ ID NO: 62408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatgcaacaaagcaatctcacagtatcta

SEQ ID NO: 62409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatggaataggagatcaagacagtccggg

SEQ ID NO: 62410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatggcacatcatcatatggccgataatt

SEQ ID NO: 62411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatggctcaatgatgcctagcatgggcgg

SEQ ID NO: 62412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatgtcaagtgcggcaacgcttcatcagc

SEQ ID NO: 62413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaatgttgcaacagacggattggggacagc

SEQ ID NO: 62414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaattgcgcgttggcggtccggccttgctg

SEQ ID NO: 62415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaaacacctgcatacctcgttgcggtac

SEQ ID NO: 62416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaaatgccgggattcgggggatttctgg

SEQ ID NO: 62417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaacagttagtgcgcccttagtatagac

SEQ ID NO: 62418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaactcgcataagtaaacacgttgggac

SEQ ID NO: 62419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacacacaattgcaactcgcggtaccttgc

SEQ ID NO: 62420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacacagagccgcgcgcaatgttcggtttg

SEQ ID NO: 62421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacacagtgcaatctggatgacgggcgggg

SEQ ID NO: 62422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacacccgtcatcccggccctctaggatat

SEQ ID NO: 62423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaccctaagcagcatgggatgtaatttc

SEQ ID NO: 62424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaccgcgaccctcgggatttatggcggc

SEQ ID NO: 62425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaccgtcaaacggtcttgaacaccgatg

SEQ ID NO: 62426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaccgtttgttggactgctgccagtacg

SEQ ID NO: 62427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacacgcaaggtcgttaggattgcactaga

SEQ ID NO: 62428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacacggtgctggtccggtagtagcgctca

SEQ ID NO: 62429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacacgttttccgccacgcgctcgataggc

SEQ ID NO: 62430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacactcacttatcggcgttcacgcaatgg

SEQ ID NO: 62431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacactgcggtctttaccttgtactcgtgc

SEQ ID NO: 62432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacagaagggcaattgtgaggtctgatgtt

SEQ ID NO: 62433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacagcactaataactctgaggcagctgag

SEQ ID NO: 62434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacagccttaacaatcgtttcctccgacct

SEQ ID NO: 62435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacagccttctacttcgattcaaggttcgg

SEQ ID NO: 62436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacagcggtcgagggcctatcgctgtatgc

SEQ ID NO: 62437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacagggacgaatgttatcaccaatctccg

SEQ ID NO: 62438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacaggttcctgcttcaaaccacgtgttgt

SEQ ID NO: 62439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacagtctagcgttatcgcaatttcggtct

SEQ ID NO: 62440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacatacccaatgttatcacatcgtgcgcg

SEQ ID NO: 62441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacatcgtttgggaatacttcggggtgaag

SEQ ID NO: 62442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacatcttatctgcaactccgcctctgagg

SEQ ID NO: 62443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacatgacagtccctatgaacggttcctca

SEQ ID NO: 62444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccaagaagtgtaacggggatgcgttcaa

SEQ ID NO: 62445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccaagcttccatcgcttatggtcgcgct

SEQ ID NO: 62446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccaaggcaggcgatgctctgagcgcgct

SEQ ID NO: 62447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccagattgggaccgcgtcattcatgtag

SEQ ID NO: 62448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacccaatgtgaaattgcgtacctcgtcct

SEQ ID NO: 62449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacccaccccctaggtttgctagacaacca

SEQ ID NO: 62450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacccaccgtgaattcaccgttgcttgtta

SEQ ID NO: 62451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacccaggtgtagcactcattaggctctgt

SEQ ID NO: 62452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacccgacttttttgacgtgctcgacacac

SEQ ID NO: 62453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacccgccagcaatgccaccaacttagttc

SEQ ID NO: 62454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacccgggaagcagaaatcacgtggcatgt

SEQ ID NO: 62455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccgaatccggaccgcaacctgagccggg

SEQ ID NO: 62456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccgcagggcaaacagcttcgtgccgcac

SEQ ID NO: 62457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccgtatggtcatttgttcctttgagttt

SEQ ID NO: 62458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccgtcaccctcgtgcgctcaccgcctgg

SEQ ID NO: 62459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaccgtgatgtacctctatactttggaggg

SEQ ID NO: 62460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacctcccacggcggatcttcgggcgctgc

SEQ ID NO: 62461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacctccttgatctggtcaagtactcggca

SEQ ID NO: 62462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacctcgggttaccattaaatttcctcgtc

SEQ ID NO: 62463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacctctaaatcagtttaacgaccggcctt

SEQ ID NO: 62464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacctgatcagaacacaccaaccgggacgt

SEQ ID NO: 62465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacctgcgggatggttattggctcggaatc

SEQ ID NO: 62466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacctggtttgttccggtaccgcaattgta

SEQ ID NO: 62467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgacccggtggtagacgtacaatccccg

SEQ ID NO: 62468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgacgcgactggcccaatgaagttcctc

SEQ ID NO: 62469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgactccaagtgaggagcgaaaggtggt

SEQ ID NO: 62470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgagcgctcatcatcgtccaggccgact

SEQ ID NO: 62471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgagcttcatgtgcagcaggacgttcgc

SEQ ID NO: 62472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgaggctgacacattcccagggcatgtc

SEQ ID NO: 62473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgcacgctacatgccatccccggctctt

SEQ ID NO: 62474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgccgtatactatttcgcgtttggatgt

SEQ ID NO: 62475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgcctagtgacctgccgcgtgaagaggg

SEQ ID NO: 62476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgcgaacggggcctcgggattaacggcc

SEQ ID NO: 62477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgctgaatgggttaaaggccccgagcgc

SEQ ID NO: 62478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgctgctccgctaggttatgcgcgtagg

SEQ ID NO: 62479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgcttgctttgactaccctccgctgacg

SEQ ID NO: 62480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgcttgcttttgcatctccttatctacc

SEQ ID NO: 62481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgggaaacataccccaccccgtagcttg

SEQ ID NO: 62482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgggaaccgtatttagtcctaagtgatt

SEQ ID NO: 62483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacggggtctatcgcgcacattagttagct

SEQ ID NO: 62484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacggtagccggacgcatctgattccactt

SEQ ID NO: 62485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacggtggggccgggttcatagtgcgtcaa

SEQ ID NO: 62486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgtacgacacggatcgtctgcgcctagt

SEQ ID NO: 62487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgtcagtcagcttgggacacacgctcgg

SEQ ID NO: 62488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgtcgcgctcttggtatttgatattggg

SEQ ID NO: 62489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgtcggtgctaggatgggtaaagggcgc

SEQ ID NO: 62490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacgttatcaggctggggaagggtgttcct

SEQ ID NO: 62491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactaaacggtgtggcgatgtacctccctc

SEQ ID NO: 62492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactattcagagacaaaccgcctatcatat

SEQ ID NO: 62493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactcaccgctcttgctggtcgtgcgtgca

SEQ ID NO: 62494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactccataccctacgaaaggccgttgaca

SEQ ID NO: 62495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactcgaacttccgtgaacgttgcgctaag

SEQ ID NO: 62496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactgatgccaacaggcctgtagagcttgt

SEQ ID NO: 62497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactgcttatccatcggtcttttcgttgcg

SEQ ID NO: 62498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactgggtaatccaagctcaagcgatggca

SEQ ID NO: 62499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactggtcttgttcttcctggtgaccgtac

SEQ ID NO: 62500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactggtgacggtacatgaccaaactgcaa

SEQ ID NO: 62501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacttatcaaacgcggtacaattttactca

SEQ ID NO: 62502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacttctgtgaactctctccgaaaccctgg

SEQ ID NO: 62503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacttgtcacgaatggaactggcggctagc

SEQ ID NO: 62504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccacttgtcgtgcagcactgttacctacacc

SEQ ID NO: 62505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccactttgcgcgaccggttatgtcgatcgac

SEQ ID NO: 62506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagaatcacactgggcttggtttttcgatg

SEQ ID NO: 62507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagaattacattaacgacatgtgactgggg

SEQ ID NO: 62508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagacagagcgtacacggtggcgttcagca

SEQ ID NO: 62509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagaccaccggaaaggggaggcccgggagt

SEQ ID NO: 62510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagaccgcgttatcgttatctgtcgcgtca

SEQ ID NO: 62511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagacgcgatccctaggttgcacgtcctct

SEQ ID NO: 62512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagactcgatcgaaacaattcccggctatc

SEQ ID NO: 62513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagactttcctttggccggggttctgctgc

SEQ ID NO: 62514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagagagaaactttcatgcacatcagcatc

SEQ ID NO: 62515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagagatcacacctgtgctctgattagatc

SEQ ID NO: 62516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagagcggcgttaccttttccacaggtcgg

SEQ ID NO: 62517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagagcggtggtagcctggtgatcgtacca

SEQ ID NO: 62518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagagcgtctagttgaccgaacgcttttac

SEQ ID NO: 62519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagagctcactttcagtcgagacaagtcat

SEQ ID NO: 62520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagaggagacgggtcaaagaaggcatcaag

SEQ ID NO: 62521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagagtagtctcacgtcggcgattggactg

SEQ ID NO: 62522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagagtcaagaaagacgcacacccacatag

SEQ ID NO: 62523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagagtggggatgaatgagggcataaaatc

SEQ ID NO: 62524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagatagttcacggtgccataaatagtccg

SEQ ID NO: 62525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagatcgcgagagcagatcgcagctcgtag

SEQ ID NO: 62526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagatggacgggttatcatgcggtcctacg

SEQ ID NO: 62527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcaaagggcggggcgaatcgacgtggtc

SEQ ID NO: 62528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcaacaccagaatacaactcctcttcga

SEQ ID NO: 62529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcacagttctctgtaatttccgcacccc

SEQ ID NO: 62530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcactttggctacttccagcgactcaag

SEQ ID NO: 62531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcagacagctaggaaacaagggctacat

SEQ ID NO: 62532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcagattcgatgtaggcggccatgccca

SEQ ID NO: 62533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagccactgcacacgctggatcactaccgc

SEQ ID NO: 62534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagccagcccggacatttctgctgctgagg

SEQ ID NO: 62535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcccaatagaaaggttgaggaggcgtgc

SEQ ID NO: 62536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagccggagtcaggttggcaggtgggtgac

SEQ ID NO: 62537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagccgtgttcctcgctcagctgcagtttg

SEQ ID NO: 62538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcctcataatttcgggtctaaggtatag

SEQ ID NO: 62539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcgaatggcctgctgtgatcagatcacg

SEQ ID NO: 62540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcgcaaagtagtgtagtcgcttgacggc

SEQ ID NO: 62541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcgcccgtctattttctgggtttgttga

SEQ ID NO: 62542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcgccggaggatagtgggttcttgtgtg

SEQ ID NO: 62543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcgggaattcgtatatcactcggcactg

SEQ ID NO: 62544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcgggagaccttgggttctagattgtgt

SEQ ID NO: 62545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcgttatctattctcgctcgatgcctcg

SEQ ID NO: 62546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagctgacgttgggtgttgacggtacagaa

SEQ ID NO: 62547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagctgatcacggtgcgattcggtgcttgc

SEQ ID NO: 62548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagctgtctatcggccgggctacgataagg

SEQ ID NO: 62549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagcttgaagttacccgttttgaacataaa

SEQ ID NO: 62550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggagctggacccttcggatcgcacgaga

SEQ ID NO: 62551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggataggtgtttaatttgtaacagcaca

SEQ ID NO: 62552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggatgtagatggtgcccgtgatctggta

SEQ ID NO: 62553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggattaactaggttttccgtctaagacc

SEQ ID NO: 62554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggcacgtaattgaccagtcagtgacccg

SEQ ID NO: 62555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggccaaacaccgtaatcatttatgcgtt

SEQ ID NO: 62556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggccactgaaggcgaatgtggtgcctgg

SEQ ID NO: 62557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggccgcaggtggttatgattgtcctcat

SEQ ID NO: 62558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggcggctccaccccgtcaccctttcggt

SEQ ID NO: 62559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggcttaggccgagagtcaccgctaggag

SEQ ID NO: 62560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggcttgcttcgttttttggtggtcctac

SEQ ID NO: 62561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggcttgtaacataagttaattgcgaaag

SEQ ID NO: 62562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagggacaactgatgcaataggcctcactc

SEQ ID NO: 62563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagggacacgcgcacggttactctgtgatt

SEQ ID NO: 62564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagggcttcggggtaaggcgtgggctgcct

SEQ ID NO: 62565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggggtaaaaagaaggctatgatagattc

SEQ ID NO: 62566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagggtgtccgtgctgttgcgatcggtctc

SEQ ID NO: 62567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagggttcctttagtgcgctgctagcgttt

SEQ ID NO: 62568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggtccgagtgctgcagcggagtgtttgc

SEQ ID NO: 62569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggtcgacacgatttgacactcacgcgct

SEQ ID NO: 62570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggtcggtggtacgctctacccgataatt

SEQ ID NO: 62571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggtgaagccgaacaatggtttagagacg

SEQ ID NO: 62572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggtggcgtgaaatttacagagtgtccca

SEQ ID NO: 62573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggtgtcacctcctttattgttcgagcct

SEQ ID NO: 62574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggttatatggcgaggtgcgtaccattag

SEQ ID NO: 62575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggttcgccgctcgttatgccccctcgcc

SEQ ID NO: 62576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggttgagcaccctttcagctatcgcgtg

SEQ ID NO: 62577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccaggttggcatgtcttagacctcgacgtaa

SEQ ID NO: 62578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtagtcagacacaaaagggaagccatta

SEQ ID NO: 62579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtcccgaattctgctgcgagtacgattc

SEQ ID NO: 62580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtccgaccgctatcaacccggactcgag

SEQ ID NO: 62581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtcgtaggatatgtgcctgtcagagtgc

SEQ ID NO: 62582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtctggtagagtagggacatatcgcgta

SEQ ID NO: 62583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtcttgcattgttgggttggcatatgat

SEQ ID NO: 62584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtgacgcgcggactttaaggcagcaggt

SEQ ID NO: 62585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtgaggttggcgggtcaggcagttctgt

SEQ ID NO: 62586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtgatccttaggtagcgagcccgcatgc

SEQ ID NO: 62587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtgcacacggcgtgctgacggtgggtat

SEQ ID NO: 62588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtgcctaccagctttcgggcagcggccg

SEQ ID NO: 62589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtgcgagactgttcgcctttctacggtc

SEQ ID NO: 62590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtggacttcactgctgccaattccaagc

SEQ ID NO: 62591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtggagcatctatgccgggttgacacta

SEQ ID NO: 62592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagtgggttgtctaaaggggtgaaggggcg

SEQ ID NO: 62593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagttaccttagaccgctcgagaaatatgg

SEQ ID NO: 62594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagttagaccggtatgcccctcccgcgcgt

SEQ ID NO: 62595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagttcctccactaagaataactgatgatt

SEQ ID NO: 62596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagttgcaacaaggatcagctactttagac

SEQ ID NO: 62597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagttgcgcatagtacagttcgaggctgac

SEQ ID NO: 62598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagttgcggcactatgttggtgcagcgaaa

SEQ ID NO: 62599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccagttggagggggaaggtatgtttcgtccg

SEQ ID NO: 62600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataaaagcaatgtcgtttggtttccaagg

SEQ ID NO: 62601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataaccgacgtgcctcaatgatatacggt

SEQ ID NO: 62602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataaccgtaacccgccatgttctgagccg

SEQ ID NO: 62603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataacggagatcgttgcgcagggggctag

SEQ ID NO: 62604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataacggcagtatggaatcggcctagggg

SEQ ID NO: 62605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataactgcgatccaatccagtatcgaaag

SEQ ID NO: 62606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataaggcagacaacggactgaaactcttc

SEQ ID NO: 62607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatacccaagagtatcggcctgaactaatt

SEQ ID NO: 62608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatacccgccgttctttctgcgtttgacct

SEQ ID NO: 62609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatacgggccggaagcaggggctgatcccc

SEQ ID NO: 62610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatactcgactcatccttaggggtgcccgc

SEQ ID NO: 62611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatagagcggtaaataaatcagaaggtcct

SEQ ID NO: 62612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatagagggaccatcacactgaagacaggg

SEQ ID NO: 62613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatagcctagcataaccacactcggctgcg

SEQ ID NO: 62614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccataggctgtggttctcaggaagctgtgca

SEQ ID NO: 62615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatatcgtggtggcttaaaagcacgtatcc

SEQ ID NO: 62616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatatgctgtggtcgcacccgatacccatt

SEQ ID NO: 62617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatatgtggttcagatctgcttcgtcttgt

SEQ ID NO: 62618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcaattagtgcgtattttgataatcagt

SEQ ID NO: 62619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcagatctgttgcggaggtgctcggtag

SEQ ID NO: 62620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcaggcttagagggtataaaagcgtaaa

SEQ ID NO: 62621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcagttccgcacatatgatctactccgg

SEQ ID NO: 62622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcatactgggagtcaggtgctttcagtt

SEQ ID NO: 62623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcatgccggacgtgccatccctgatcgt

SEQ ID NO: 62624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcattttccgatgctgatcttctctgct

SEQ ID NO: 62625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatccgaggagaagtaggggtcgttcgcga

SEQ ID NO: 62626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatccgtgggtggtggcagcgctatctcgg

SEQ ID NO: 62627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcctgcgctgatagtaaaccggggcggg

SEQ ID NO: 62628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcgagggttgtggcggcaaagcatgctc

SEQ ID NO: 62629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcgcaaaccaaagtgagggcaaaggatc

SEQ ID NO: 62630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcggattggtttcgaaagcctcgtaggg

SEQ ID NO: 62631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcgtcgagtgggtacaagatgagatgct

SEQ ID NO: 62632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcgtcttttacttcgatttgtttggggt

SEQ ID NO: 62633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatctagctgccttttcttttgcttaaatt

SEQ ID NO: 62634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatctgttgatctgttcatgtctgttcctc

SEQ ID NO: 62635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcttgaaccgattgcgtagtccacttgc

SEQ ID NO: 62636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatcttttacgtacacccagtatacgactc

SEQ ID NO: 62637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgaatgatcagtgtgttaacggtagtgc

SEQ ID NO: 62638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgacgggggccagccccttgaccgccgc

SEQ ID NO: 62639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgagagcggtagtatatgagtcgctggc

SEQ ID NO: 62640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgagtcttttagggggtgcttacgtgcg

SEQ ID NO: 62641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgagttactacatggtctgagagctggg

SEQ ID NO: 62642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgattggactacagtaatggcggctcgt

SEQ ID NO: 62643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgccaatggaacagggctttgcacgtgt

SEQ ID NO: 62644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgccatcaacgatgcgtgctaatttggg

SEQ ID NO: 62645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgcgacgattcgtgctcatattcggtcc

SEQ ID NO: 62646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgcgataggtaggaccaactcgcgggct

SEQ ID NO: 62647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgctattgccgccggggtgtcgaactgt

SEQ ID NO: 62648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgctcaacccgacattcgcgtaacacat

SEQ ID NO: 62649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgctgcagcactctcgtggggtctggcg

SEQ ID NO: 62650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatggactcccacaatttttgcgttgatga

SEQ ID NO: 62651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatggcagggctacgaaccgggtctatctg

SEQ ID NO: 62652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatggcagtgttgtctctgtgaggggagct

SEQ ID NO: 62653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatggcccgggacagcaacttcacgtttat

SEQ ID NO: 62654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgggtggctgaaaagagtctattcatct

SEQ ID NO: 62655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatggtgaagtcgcttcgtcacgcacaata

SEQ ID NO: 62656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatggttcgtgacggtgtcttctattcttc

SEQ ID NO: 62657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgtcaaaatttgacgcaacggcacgcct

SEQ ID NO: 62658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgtctaccaggcaccaccgatgtttatg

SEQ ID NO: 62659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgtgtcaaattaagccactgattacccg

SEQ ID NO: 62660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatgtttgacggtctaaagaagtgtgcgac

SEQ ID NO: 62661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattaaggctcgtacaacaattcatccata

SEQ ID NO: 62662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattaagggatgtgctatgttattattcca

SEQ ID NO: 62663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattaattcgtatttcaatcccgtctaggt

SEQ ID NO: 62664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattacattcgatctagtctttttctgtta

SEQ ID NO: 62665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattagggcgcgtgggtgtgtgaggtttgc

SEQ ID NO: 62666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattatagacatcgttctttacgcttcctg

SEQ ID NO: 62667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattatcttttgtctagagtttagggtagt

SEQ ID NO: 62668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattatgcctggtgtggttagggcagcgat

SEQ ID NO: 62669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattcagaacttgctgatctaaaggaggtg

SEQ ID NO: 62670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattctggtctagtcctccactgttaagta

SEQ ID NO: 62671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattcttgtagatcacatctatcgtttatc

SEQ ID NO: 62672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattctttatcaattcaggtgcacagtcaa

SEQ ID NO: 62673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattgcccttacataagaaagtatcttcgt

SEQ ID NO: 62674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattggagtctcacctgtagcgcgtacgta

SEQ ID NO: 62675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccattgtttctctgttcgttcctgctcgtcg

SEQ ID NO: 62676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatttatagacgcggattatgtcacgccac

SEQ ID NO: 62677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccatttatgagcggagtcatagttacacgtt

SEQ ID NO: 62678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaaacactgacaatattgctcaacgtcgc

SEQ ID NO: 62679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaaatgatgcgagtatttttcaacacgac

SEQ ID NO: 62680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaacgcggttgcctaagttaatagtctgg

SEQ ID NO: 62681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaactacgcagctgcacgtctgcgacgac

SEQ ID NO: 62682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaagaatgaacgcagctcttagtcctcac

SEQ ID NO: 62683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaagaatggacagacagattatctagtaa

SEQ ID NO: 62684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaagcaaagagggctttgttcttacgatg

SEQ ID NO: 62685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaagggttcgttgggtagtttggcccctt

SEQ ID NO: 62686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaagtcatttgtcaggttcgttcgacgga

SEQ ID NO: 62687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaatgaataactagactctactagataaa

SEQ ID NO: 62688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaatgctgctaccttgattcgacactggc

SEQ ID NO: 62689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaatggagtatttctcgtcttcgcgtccg

SEQ ID NO: 62690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacagacttggtgtgacgcacttgggatg

SEQ ID NO: 62691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacagatccaggtaacggaagctgatttg

SEQ ID NO: 62692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacatccgcgcaacgtccaggcgattccg

SEQ ID NO: 62693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacatcgcggtccatatgaagccattggg

SEQ ID NO: 62694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacatcgtccttctgagtgttataggtcc

SEQ ID NO: 62695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaccacacggctctatgggtccgacggca

SEQ ID NO: 62696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaccaggttgctaagttcggtaactgtgt

SEQ ID NO: 62697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaccagtggtatgctagcaagcatgtcgc

SEQ ID NO: 62698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaccatcgctttgagcccagcgtatgccc

SEQ ID NO: 62699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacccagccgtggttcatattgcatctgg

SEQ ID NO: 62700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaccccggcgctcgacttgcctatcggcc

SEQ ID NO: 62701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaccccttgcgcatacagagttcgcaaac

SEQ ID NO: 62702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacccgcaaggcacgatgttttgggcatc

SEQ ID NO: 62703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaccggctcgtgcttcattggacgggcgt

SEQ ID NO: 62704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaccggcttgcacaagaacccagagcgtt

SEQ ID NO: 62705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacctcgtagcagaacacgtggggatctc

SEQ ID NO: 62706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacgaatattcgatgtttcctcgcgcggt

SEQ ID NO: 62707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacgatggtcaaccctaggctgcatggcc

SEQ ID NO: 62708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacgcccctagcaacttgtccctcacgtc

SEQ ID NO: 62709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacgccggtccgcaggtattgatcactcc

SEQ ID NO: 62710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacggataacacggctggtcacgcgtccg

SEQ ID NO: 62711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacggatcaccggactacttgcgcttttg

SEQ ID NO: 62712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacgggcatgattgagtaagtaggggaca

SEQ ID NO: 62713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacgtccggctttggaccgagaattcggc

SEQ ID NO: 62714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacgtgcaaagtggtgcgggacggtgctt

SEQ ID NO: 62715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccactaaatacgttctgacaggtcgttcgt

SEQ ID NO: 62716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccactatagtcccatctggcctatgcatgt

SEQ ID NO: 62717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccactccctttgacacgagacttcgtagcc

SEQ ID NO: 62718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacttcccgccgctccgtcgatgcatcat

SEQ ID NO: 62719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacttcctgtttactgtcgttcccttcgc

SEQ ID NO: 62720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacttggttctggcagatcccgtcattat

SEQ ID NO: 62721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccacttttgagacttatcaccaggagcact

SEQ ID NO: 62722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagaaatgacgcgccaggtagaggagagg

SEQ ID NO: 62723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagactaaggacccagcgcgatgctgtgg

SEQ ID NO: 62724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagactgcgctccacctagctatccgcac

SEQ ID NO: 62725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagagggttcgcgtcacggttgtactgga

SEQ ID NO: 62726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagcatcttcggcacgtccctcgttggtt

SEQ ID NO: 62727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagcctccttgattgggtgtcttaagctg

SEQ ID NO: 62728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagcggcagagagacaacggccctgaggg

SEQ ID NO: 62729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagctctgagtcccaaatgattgtttagt

SEQ ID NO: 62730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaggctgtcactggtggtggtggtaccga

SEQ ID NO: 62731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaggcttgtcgtagggctatggctacgct

SEQ ID NO: 62732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagggagagcacagtctggatgggcatgc

SEQ ID NO: 62733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaggggggttatatttctgaacagtgact

SEQ ID NO: 62734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagggttcggctggatggcaggagcggtg

SEQ ID NO: 62735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccaggtgacacgattaatctgtagccgcat

SEQ ID NO: 62736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagtacattcttcattgatatgtagttct

SEQ ID NO: 62737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagtacctgcgaggtatccctctattggc

SEQ ID NO: 62738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagtccggtactacccagaaagggcgctg

SEQ ID NO: 62739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagtgactacgactcagtgacgtcaattt

SEQ ID NO: 62740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagtgagcgggaggtatcacaaatcgtta

SEQ ID NO: 62741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagtgatcacacgttcgaggtgtttatcg

SEQ ID NO: 62742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccagtgtaatatgcgatacgtgatggtggc

SEQ ID NO: 62743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatacgcctgtgaaatatgctgcttgacg

SEQ ID NO: 62744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatacgtataagaatagttctgtgcgcga

SEQ ID NO: 62745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatagctcattgccagcgcgtgcgtcggg

SEQ ID NO: 62746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccataggcttgaacttgcaggcgcgctctt

SEQ ID NO: 62747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatagtgacgcgcggctacgaagagggtg

SEQ ID NO: 62748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatcaacccatgcatcggaagtagtgcca

SEQ ID NO: 62749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatcaacccgcatagaacggcactaagtg

SEQ ID NO: 62750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatcagtgggcttccaataggcgtagatt

SEQ ID NO: 62751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatcccatttttacgcgtttccgggaaat

SEQ ID NO: 62752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatccttgtgtgctcctggggatgtgccg

SEQ ID NO: 62753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatcggaacccctcgaccgatgtcaacga

SEQ ID NO: 62754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatcggtgtgactgttctacctaacgcac

SEQ ID NO: 62755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatcttcagactgcatgactgtgacagtc

SEQ ID NO: 62756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatcttcgagtaggttcgaggctgttccg

SEQ ID NO: 62757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatgaagccccattcagttgtcacgcggc

SEQ ID NO: 62758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatgcggctccagttctggttagtcatgc

SEQ ID NO: 62759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccatgctcagttccaggtttagcccttgcc

SEQ ID NO: 62760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccattcgtcccgtgggttgttctgatcgac

SEQ ID NO: 62761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccattgaactaacatccgccgttatgcatt

SEQ ID NO: 62762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccaaactctgtatgattacggcgctagcg

SEQ ID NO: 62763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccaacatccaaagggcgcttaagctccgc

SEQ ID NO: 62764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccaacgtgtcttccaagacagaagtccaa

SEQ ID NO: 62765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccaagtcactggtacgctggtcgttacgg

SEQ ID NO: 62766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccaatagcgtaggagcgtggtttttttcg

SEQ ID NO: 62767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccacaacgccattcacctccctttaccac

SEQ ID NO: 62768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccacaagggttttctgcttagtagggtcc

SEQ ID NO: 62769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccacgcttcggcaaggcctcacatgtaga

SEQ ID NO: 62770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccacggagcgatacccggcgggctgttgc

SEQ ID NO: 62771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccactcatgccggattgccttgatcctgg

SEQ ID NO: 62772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccacttcgtactatcccggggagttcgtg

SEQ ID NO: 62773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccagaggcatccgtctcttggaacgttta

SEQ ID NO: 62774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccagcgcatttttgccttacatagggagc

SEQ ID NO: 62775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccaggcctacgttgcatgattgccctcgc

SEQ ID NO: 62776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccagggcatataactgcgtggagcggacg

SEQ ID NO: 62777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccagggctttccaccagttgagcgtatgg

SEQ ID NO: 62778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccagtctgcggtcgtttggagttcgtaca

SEQ ID NO: 62779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccagttgttcatttgtgtcccttctcact

SEQ ID NO: 62780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccataagcctccgaggtttttatctgggg

SEQ ID NO: 62781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccatatacaattcggcatactcgtgagtt

SEQ ID NO: 62782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccatgaggggagactggtctcaactggac

SEQ ID NO: 62783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccatgatatccacatacgaccctagaagg

SEQ ID NO: 62784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccaacacgagtttagctgcggtagtcat

SEQ ID NO: 62785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccacgggcccacctggcaggaacgggcg

SEQ ID NO: 62786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccactgcgtatggataagaccatcccgt

SEQ ID NO: 62787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccatgatccactactgcgcggaccgacc

SEQ ID NO: 62788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccatggacggaggtgtggccaattgttc

SEQ ID NO: 62789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccccgcgccgcttaccaacctatgtgccc

SEQ ID NO: 62790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccctcgatggcgctacatggttgaggag

SEQ ID NO: 62791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccgaggacgacacccgcagctctaggac

SEQ ID NO: 62792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccgatagccagtctgttgggtctcccgg

SEQ ID NO: 62793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccgcccctaatcttatcggatcacgcca

SEQ ID NO: 62794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccgggccatcaccataccatgcagggat

SEQ ID NO: 62795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccggtgtaacttgcacctaaggcgcgta

SEQ ID NO: 62796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccccgtaccccatcctccgaattccctgtg

SEQ ID NO: 62797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccctacgtgtagttagagattctcgcctc

SEQ ID NO: 62798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccctactagaagaaattcaccgtttcttg

SEQ ID NO: 62799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccctcaaccctcagttattcgaggtatcc

SEQ ID NO: 62800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccctctccggtggagaatttggagcggcc

SEQ ID NO: 62801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgacactctcgcggtcaactatctcgcg

SEQ ID NO: 62802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgacagacagaaagggcgcgtggctact

SEQ ID NO: 62803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgagagaggaggacaccgtagttgcttg

SEQ ID NO: 62804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgattcatttccagcggcctcgagcggt

SEQ ID NO: 62805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgatttctgttttgggttggcccgactt

SEQ ID NO: 62806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgcacaccatgtgattgtatgtactgaa

SEQ ID NO: 62807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgccaggtgttagttcctgtgcccaatg

SEQ ID NO: 62808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgccccattttgtcgagcgtcctttcgt

SEQ ID NO: 62809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgcgacggactcactcgtgctccgggga

SEQ ID NO: 62810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgcgcctcaacgtgcgccacgtactttt

SEQ ID NO: 62811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgcgcgcacagccgccgacagcagggtc

SEQ ID NO: 62812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgcggtccgagaattccggcgcccactc

SEQ ID NO: 62813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgcgtcatgcgttcatcaggttaagccg

SEQ ID NO: 62814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgctcgagccccctgtattgaagtcacg

SEQ ID NO: 62815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgctggaaaaggtccaggtccgggctac

SEQ ID NO: 62816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccggacgatcagtcgtttctgcggatccc

SEQ ID NO: 62817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccggaggccacaaaggtagaggtggtttc

SEQ ID NO: 62818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccggatttgtggcacctgcgaggcagcga

SEQ ID NO: 62819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgggaaaaatgcggtcgttagagcgctc

SEQ ID NO: 62820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgggagtctgtaccactccgacgcatgg

SEQ ID NO: 62821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgggcatgtgattggtgtgatttgccta

SEQ ID NO: 62822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgggtataatgtttcaccgtgtgttttc

SEQ ID NO: 62823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgggttctccctcggcgcatcagtgtat

SEQ ID NO: 62824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccggtggtttttctcgtagcccactaccc

SEQ ID NO: 62825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccggtgtgcgtcctgcgggggctcgcatg

SEQ ID NO: 62826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccggtttagtttcgtgacgcgtggattgc

SEQ ID NO: 62827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgtaacctggttgcagcgcgccatgctc

SEQ ID NO: 62828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgtccgagtagtcgacttagcgattcga

SEQ ID NO: 62829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgtcgcctgtgtgtttcggactggatcg

SEQ ID NO: 62830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccgtggagtggcgaaggggtggacaatgg

SEQ ID NO: 62831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctacaaggcagccgtaagagttggtctg

SEQ ID NO: 62832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctacgtggcaatggcggcgtctgttggt

SEQ ID NO: 62833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctagtcataacatgtaagggaatcggga

SEQ ID NO: 62834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctagttgtgagatcagctcgatagaaag

SEQ ID NO: 62835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctattagttgcaccgagcttttccttcc

SEQ ID NO: 62836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctcactgtgcttccagaggtcttctacg

SEQ ID NO: 62837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctcagtaaggatctgtttttgttgccgc

SEQ ID NO: 62838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctcgcagacctggactaagcgatccggt

SEQ ID NO: 62839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctcgctcgcttaaagtacaggcagaatg

SEQ ID NO: 62840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctctccatagggtagtcgcactaggggt

SEQ ID NO: 62841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctctgttggaccatctgtcttgcgggtt

SEQ ID NO: 62842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctgagcaatgatgaagccattgcattgc

SEQ ID NO: 62843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctgtcagtgtgcaatcccagtgccagtc

SEQ ID NO: 62844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctgttagtggcacacgaaagtactttgt

SEQ ID NO: 62845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccttaacaccaactgattcggttcacgtc

SEQ ID NO: 62846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccttacctggttccggcgcgaattttggc

SEQ ID NO: 62847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccccttcccgtcgtctgggcgtcctatcttc

SEQ ID NO: 62848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccctttagccccgccatgtattaggcatca

SEQ ID NO: 62849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgaaaatgacatcgtccactggtttgcgg

SEQ ID NO: 62850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgaaccttcccctgggtgtcttcaccggg

SEQ ID NO: 62851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgaagagcgcacgaggtatctgtagccgg

SEQ ID NO: 62852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgaagcaggcaccagttcctactcgctgc

SEQ ID NO: 62853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgaattctcatgcggggtaaaagggtagg

SEQ ID NO: 62854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgacaaatggtgcaaaatcccctcgctgg

SEQ ID NO: 62855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgacatggaggcatcttcctcctggcaag

SEQ ID NO: 62856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgacgatagtggggatctgcttgcatctg

SEQ ID NO: 62857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgacgcaccgaggcaccactgtgatgtca

SEQ ID NO: 62858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgagaagcctcagcgcgtttttgctagcg

SEQ ID NO: 62859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgagacggtgggagttccagaatgctgtg

SEQ ID NO: 62860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgaggcgtgcagtatggtttcattacgtc

SEQ ID NO: 62861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgaggtaaacgagtctaggttgttggggc

SEQ ID NO: 62862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgaggttagcgtcactcgcctccattgcg

SEQ ID NO: 62863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgataagtacatggcacagtagctatgga

SEQ ID NO: 62864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgatagcagtctttactagatgcccactg

SEQ ID NO: 62865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgatcacggggaaatcagtttcatggttg

SEQ ID NO: 62866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgatcctacttctccatgtgcctttcgtc

SEQ ID NO: 62867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgatcgaactggtgctgctgtgcaagccc

SEQ ID NO: 62868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgatgcgtcagggcagtgttggcttcccg

SEQ ID NO: 62869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcaagacgtctcgtgaccaacagacggg

SEQ ID NO: 62870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcacaacctgtatgtcagcaccccacac

SEQ ID NO: 62871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcacaggtcatggtaaaaccgcgttgtg

SEQ ID NO: 62872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcacatttacaaaccagatcgcgctctt

SEQ ID NO: 62873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcaccaggagaaggcatgggcgacgacg

SEQ ID NO: 62874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcaccgacaagcacgatacctgtctgtg

SEQ ID NO: 62875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcaggcgatgtatgcgacggggtaatgc

SEQ ID NO: 62876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcagtgcaatgcgagtggggtggcatag

SEQ ID NO: 62877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcagtgtcaggagacaagctttcaagag

SEQ ID NO: 62878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcatactagtcgtctgccccgggttagt

SEQ ID NO: 62879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcattggtgatggcagagggaagacggg

SEQ ID NO: 62880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgccagcattcccgcgtttatggaggtgt

SEQ ID NO: 62881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcccggagtttgccctccatcatgcgtt

SEQ ID NO: 62882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcccgtccctacttaagatgtgttatta

SEQ ID NO: 62883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcctacccacattgtttgcggattgcac

SEQ ID NO: 62884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcctcgatctgccaacgctgctattaca

SEQ ID NO: 62885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcgaacttctcggtcacccagcccgctc

SEQ ID NO: 62886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcgcagccttatctgcacatcggtttag

SEQ ID NO: 62887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcgctggtcttttgttccgttcctccgt

SEQ ID NO: 62888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcggctgactcactcagcgttgctttgg

SEQ ID NO: 62889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcggtaagaagtcatcctatgtctgtct

SEQ ID NO: 62890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcgtaactactgggcgccatcttggtgt

SEQ ID NO: 62891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcgtgattacaaaggtgatactggcttt

SEQ ID NO: 62892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcgtgggcaagactgcccaatgagctag

SEQ ID NO: 62893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcgttggtgagaaacatcatgcgactcc

SEQ ID NO: 62894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgctaagtagttctcttgcataggcgagg

SEQ ID NO: 62895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgctaatcatgtccgtgcgaagtgggggg

SEQ ID NO: 62896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgctatacgacgttggttattacgcagat

SEQ ID NO: 62897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgctcgttgtagagtgatcgcactcatta

SEQ ID NO: 62898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgctcttaagtgcaggctgatcctcggat

SEQ ID NO: 62899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgctgaaccgctagccgatcgtcacatgt

SEQ ID NO: 62900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgctgcaccaaagaggttgcaagaaaccc

SEQ ID NO: 62901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgctgtttcagttacggttcccaggtgtg

SEQ ID NO: 62902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcttaatgggtcatcttaacccccctgc

SEQ ID NO: 62903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgcttcgttgcagagttcctgttggcgtg

SEQ ID NO: 62904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgctttaagctgcaggagtgatgatggag

SEQ ID NO: 62905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggaatacatggatcgctgccttttgacg

SEQ ID NO: 62906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggaatcggtcttatgtcacctgcgcggc

SEQ ID NO: 62907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggacggtgtcggccggttttgtcataat

SEQ ID NO: 62908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggagactcgcgatcttcggtggttgggg

SEQ ID NO: 62909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggataagaatctaacgaggcttctattc

SEQ ID NO: 62910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggatattggtcagagcgatggataaccc

SEQ ID NO: 62911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggatcgcctgtctactgatgcctccacg

SEQ ID NO: 62912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggatggtaaaaggactcctgtcgcacct

SEQ ID NO: 62913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggatgtcatttctcggcctagggcagcg

SEQ ID NO: 62914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggcaaacaggatctgcgaggctcgggtt

SEQ ID NO: 62915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggcagtctatccattatgctggcttggt

SEQ ID NO: 62916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggcagtgtttgcgccggcagtatttcgc

SEQ ID NO: 62917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggcccactcaatcatccggggcttcacg

SEQ ID NO: 62918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggcccgcgcctcaatacacaattggata

SEQ ID NO: 62919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggccgttagatcgatcgtattcgtgtag

SEQ ID NO: 62920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggcctaggggatggaacgaatggtaggg

SEQ ID NO: 62921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggcgagaggcatgattactacggtattt

SEQ ID NO: 62922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggcgcgtaaaggggttcagagacctgcc

SEQ ID NO: 62923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgggctcatgcaaacacggaatgttgggc

SEQ ID NO: 62924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgggcttagtagttacgcgtcctcggctc

SEQ ID NO: 62925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgggggtggagctccggtcggtagaggtc

SEQ ID NO: 62926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgggggtgttcagaccaatcgaatgcccg

SEQ ID NO: 62927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgggtgtcggaagaaggaagcagagcgta

SEQ ID NO: 62928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgggttatatcgcgcctcgagttttatac

SEQ ID NO: 62929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggtacactatggtggcctgatccgggaa

SEQ ID NO: 62930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggtccaattagagtgaaggatagcctaa

SEQ ID NO: 62931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggtgcaacacagccacactccaggaaac

SEQ ID NO: 62932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggttcgcgttggccttttcacccgactc

SEQ ID NO: 62933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggttcggtgtcccctgctctacaatgcc

SEQ ID NO: 62934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccggttttcgtcggttttttctcttgtaat

SEQ ID NO: 62935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtaagcgtattcttgcaacgacttccgt

SEQ ID NO: 62936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtactaatgacaggccccccacctctat

SEQ ID NO: 62937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtatccaatttcacggttccttcacgtc

SEQ ID NO: 62938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtattacgttagagggtccttcttgtta

SEQ ID NO: 62939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtcaacgcgcgtcttccgctgtgttttt

SEQ ID NO: 62940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtcacaaagtctgcgcgagcctacatgc

SEQ ID NO: 62941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtcatggttacaggttccggattcctag

SEQ ID NO: 62942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtccgtagcagccaagaggcctgaggtc

SEQ ID NO: 62943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtcctctagagaatagcgtcaccgactg

SEQ ID NO: 62944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtcgggtaggtgaacgcactggaggttg

SEQ ID NO: 62945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtcggttaagccccatggtccgtggttg

SEQ ID NO: 62946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtgactcagtaacttggctccgccgcgt

SEQ ID NO: 62947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtgactctaagtggatcaggcagtcggg

SEQ ID NO: 62948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtgagcaaccgcggttccgagctatggg

SEQ ID NO: 62949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtgcctcgtcgattagtgtcggactgtc

SEQ ID NO: 62950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtgcgattaacaaaatttgtcgtgctcg

SEQ ID NO: 62951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtggaggcacagctgtgttaaccttctg

SEQ ID NO: 62952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtggccgttctgttatacttattatttt

SEQ ID NO: 62953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtgggcgcttcagttgtaccgcctcaca

SEQ ID NO: 62954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtgtggtgcgcggaagcccttgactgtg

SEQ ID NO: 62955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgttaatgacacttcccgtctttagtagt

SEQ ID NO: 62956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgttaccaaggcgcatactctcgacccta

SEQ ID NO: 62957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgttcaaatagcctagccaaggaaatgcg

SEQ ID NO: 62958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgttcaatatcggaacctgaatgcaagca

SEQ ID NO: 62959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgttcgtaaggatttagaaatcttgcacc

SEQ ID NO: 62960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgttgccgactaagccctcgtcatccgtc

SEQ ID NO: 62961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgttgctttggcgttgatggtcagagttt

SEQ ID NO: 62962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtttaaccttctctacatgcgccgtagt

SEQ ID NO: 62963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccgtttcgctagaacttgttgaatcaaggg

SEQ ID NO: 62964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctaaaactttggctggtacgacctcaaat

SEQ ID NO: 62965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctaaactgttctcttgattatcggtattc

SEQ ID NO: 62966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctaacttgttatataaacgccaacggtgc

SEQ ID NO: 62967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctaagctcttttatccgactctccaaccc

SEQ ID NO: 62968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctacaacctaactgctcaggaggccggtg

SEQ ID NO: 62969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctacaatgcggatagtatattggcggtta

SEQ ID NO: 62970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctacgacaaccacgcagtgtgaacgcatt

SEQ ID NO: 62971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctacgctacgttgaattctaagggaggta

SEQ ID NO: 62972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctacgtcactgtttgcgttcggtagagag

SEQ ID NO: 62973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctactttctcagccgcacgtttctcgtta

SEQ ID NO: 62974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctacttttcgtaacagcttggcgactccc

SEQ ID NO: 62975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctagaactgttggagccagccccgcgatg

SEQ ID NO: 62976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctagacattgccataattccgccacgacg

SEQ ID NO: 62977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctagacgcgactgtgttaccacggtttgg

SEQ ID NO: 62978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctagggtggggctcgttcaaagcacgtcg

SEQ ID NO: 62979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctagtgccatccacccatcgtagcgttca

SEQ ID NO: 62980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctatcgttcagtacgagtctctgggatac

SEQ ID NO: 62981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctatctcgtcggtgctccaacatgccccg

SEQ ID NO: 62982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctatcttgtgccgatgtgttcaaggctgt

SEQ ID NO: 62983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctattatctaacttccttaggattgtacc

SEQ ID NO: 62984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctattcaatgcacctccattcgttctagg

SEQ ID NO: 62985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcacgcatgcaggtactgagttgcccat

SEQ ID NO: 62986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcatgtctcgctcaagatgctacgtttg

SEQ ID NO: 62987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcatgttgcccgccttttgcactgcggt

SEQ ID NO: 62988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctccctactcctcagcagtttcgtgaggc

SEQ ID NO: 62989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctccgatggcactcgtgtttcatttctag

SEQ ID NO: 62990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctccgccggggtttgtggtctggcccgta

SEQ ID NO: 62991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctccgtttatcggtgcacatagccctttc

SEQ ID NO: 62992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcctctttatactcccgagagccccttt

SEQ ID NO: 62993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcgaaaatgaacatcggtccccgtgcga

SEQ ID NO: 62994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcgacttgtgccgccgggtagcctccgt

SEQ ID NO: 62995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcgaggtcagcggtctgtgtcctggccg

SEQ ID NO: 62996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcgctcgactttaccacacaaaactagg

SEQ ID NO: 62997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcggcgacagggttggccgaaatcatcc

SEQ ID NO: 62998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctctacggccgttcgctgttttggatgtg

SEQ ID NO: 62999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctctcgcaaaccagcttctgatatcgtag

SEQ ID NO: 63000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctcttaatttgggaagtggtagcctcgtt

SEQ ID NO: 63001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgaaatccccgtctcggttcttatcttt

SEQ ID NO: 63002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgaaggaactgtcaacagcgcatacgat

SEQ ID NO: 63003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgaccaccatgtatttgaattgcacgtg

SEQ ID NO: 63004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgagatctcgtgccagttgcaggacttc

SEQ ID NO: 63005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgaggcccatgcgttaaattcgattacg

SEQ ID NO: 63006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgattaacacttaaccctagcctagttg

SEQ ID NO: 63007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgattggtaaagtccctacatatacgtt

SEQ ID NO: 63008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgcctcgtcttgtctataggctcaaacg

SEQ ID NO: 63009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgcgaaatgttgttgcatccaactcccg

SEQ ID NO: 63010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgcggtgaggccaaaagtaggcacatgt

SEQ ID NO: 63011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctggcaaccgctgcaggagcgcgtaaagg

SEQ ID NO: 63012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctggcaatcaggcctatgggtacgtcccg

SEQ ID NO: 63013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctggccgcctgccgactggagttgttatt

SEQ ID NO: 63014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctggcttccagagaggtcacggtcctggc

SEQ ID NO: 63015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctggcttctggaaaccccttgttggtttt

SEQ ID NO: 63016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgggaactacgcggatcgcttacccgta

SEQ ID NO: 63017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgtccgagccagcattaactgccgcaga

SEQ ID NO: 63018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgtgcaactcgtcttgggtccagaagca

SEQ ID NO: 63019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgtgcgcactcccctgttcaggtcccga

SEQ ID NO: 63020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgtttaccttctgcggtgcacgggccat

SEQ ID NO: 63021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctgtttcacgttacttttggcgatccacg

SEQ ID NO: 63022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttaatcaatgtttctcaccgggcttagg

SEQ ID NO: 63023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttacacggtgggcagtcttccttgtata

SEQ ID NO: 63024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttcaagtcttaatctcccaggtaggagt

SEQ ID NO: 63025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttcaagttcttggcgccgctctctcatc

SEQ ID NO: 63026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttcaccatgatttaatcagtgcgggggt

SEQ ID NO: 63027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttgccccatagacgcgctacagtagtac

SEQ ID NO: 63028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttggcatgcaactaggcccatcttagtg

SEQ ID NO: 63029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttgttacaaccagtctatcggaggaacg

SEQ ID NO: 63030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctttcagtggtcatctttcaaagaccgtc

SEQ ID NO: 63031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctttccgccgcagttctgcctggtgcgga

SEQ ID NO: 63032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctttcctatttattctacctcgttcggca

SEQ ID NO: 63033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccctttctatacatgtggcagtaataggaat

SEQ ID NO: 63034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcccttttgaggcaagtgtactgtcacaggca

SEQ ID NO: 63035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaaaaagtcacgttcacctgcattttggc

SEQ ID NO: 63036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaaacgccaggatattaactaatgtgtga

SEQ ID NO: 63037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaaagcggacgtgccctcgacccccctgt

SEQ ID NO: 63038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaaatacaaccaggccggagacttgtgcg

SEQ ID NO: 63039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaacagggcctgatcgcgctaacgtcgca

SEQ ID NO: 63040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaaccatattagccaaaacgaccgtgtta

SEQ ID NO: 63041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaaccgctagttggtcctttctggtgcgg

SEQ ID NO: 63042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaacgcgagaggccggagaatgatgctcc

SEQ ID NO: 63043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaacgttcccaaagcttttttgtgtgtgc

SEQ ID NO: 63044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaactaactgatgtccgggggtcgtgggg

SEQ ID NO: 63045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaactcgccgactcctcgtggctactggg

SEQ ID NO: 63046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaactggtatggcgcatgaaacccgccca

SEQ ID NO: 63047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaacttaccgcgaacgggtatacaagagt

SEQ ID NO: 63048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaagccgatggatcgtggttggtcacagg

SEQ ID NO: 63049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaagcgcacttgaagccagcctgccccgt

SEQ ID NO: 63050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaaggaagggggataaacaatcgaccgcg

SEQ ID NO: 63051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaatacgccgctttttgccgctgaacttt

SEQ ID NO: 63052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaatcaccgagacaggttgggccaccctc

SEQ ID NO: 63053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaatcagcgaccaaatacagacacagatc

SEQ ID NO: 63054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaatcggctgagacgctctaaaataagat

SEQ ID NO: 63055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaatgaattattctgtgagttctgttctt

SEQ ID NO: 63056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacaaacaggcaaagctgctaagccatcc

SEQ ID NO: 63057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacaaccaagcgacgaaagctcctttcga

SEQ ID NO: 63058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacaactcatagaaactcgcaataaatgg

SEQ ID NO: 63059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacaccgaaagcgagtggggcggcccatg

SEQ ID NO: 63060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacagtccaatatttcgtgaggcacgttc

SEQ ID NO: 63061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacatcacagagctttaggcgaggtctgc

SEQ ID NO: 63062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacattctaccacatcgcaactagaaggt

SEQ ID NO: 63063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaccaaacttagtgcttactcacgcttgt

SEQ ID NO: 63064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacccaacggcgagctactgcccattgct

SEQ ID NO: 63065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaccccttgtagacaaaaatggagttgtc

SEQ ID NO: 63066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacctcgtgcgaataatgtgtattgatgt

SEQ ID NO: 63067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacgcagctgtcctgttaatggggagtcg

SEQ ID NO: 63068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacgcccaggataggtatttggcttccct

SEQ ID NO: 63069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacgcgtgttcgaatgaggcgtttgcagg

SEQ ID NO: 63070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacgctcaaactgtaggtgccagttaggg

SEQ ID NO: 63071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacggacaattgcaagcctcacgtgtcac

SEQ ID NO: 63072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacggcagatcagctactggggttcaggc

SEQ ID NO: 63073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacggcgagcgggagggtatcctttggag

SEQ ID NO: 63074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacgggaagagttgagtgcattatgtccc

SEQ ID NO: 63075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacgggcgcagaagctgcgtggggcaccg

SEQ ID NO: 63076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacgggcttcctaagaccttccttgtatc

SEQ ID NO: 63077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacgggtcgacctatgcctctctgtcggc

SEQ ID NO: 63078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacggtgttgggatgaatcggttggcgta

SEQ ID NO: 63079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgactatgggtctgcgcgggacgtatccgt

SEQ ID NO: 63080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgactcaccaccagaagaggttgccctaga

SEQ ID NO: 63081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgactcggtttacccgggcagcgtggtcgg

SEQ ID NO: 63082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgactgacatccctggccaactcgttgccc

SEQ ID NO: 63083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgactgttcagacccatgcgagttgatttc

SEQ ID NO: 63084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgactgtttacaagcgtatgaagtgcccac

SEQ ID NO: 63085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacttagctcgtgaccacttgctgcaccg

SEQ ID NO: 63086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgacttcttgtgcctcgcttttctcgaccg

SEQ ID NO: 63087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagaaatctattgcgaaaatccaaactta

SEQ ID NO: 63088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagaatctactgaacagaccagtaccatt

SEQ ID NO: 63089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagagcggcaaacatcatgctcacgcggg

SEQ ID NO: 63090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagagtttgcggagggagtgcctgttggc

SEQ ID NO: 63091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagcactgcgaaagcttctcccaagggta

SEQ ID NO: 63092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagcggcggtatgtgtcggcagggcagcg

SEQ ID NO: 63093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagcggctcgcctgattgcgctaaccaat

SEQ ID NO: 63094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagctcgtggtcgcctatgagatgggttg

SEQ ID NO: 63095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagctgggccattaggccaatataagcgg

SEQ ID NO: 63096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaggacgtgggtattcaatgccagtgtat

SEQ ID NO: 63097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaggcatttaccatgggaccaatttggcg

SEQ ID NO: 63098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaggcggtgaaggacagaatcaggccagg

SEQ ID NO: 63099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaggcgtaagcagttatttgcgtgtccgg

SEQ ID NO: 63100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaggggtattggcctccagagtcgtgcgg

SEQ ID NO: 63101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagggtatcttccatgtgcagccaacgag

SEQ ID NO: 63102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaggtaagggaggaggtcgacgagcttgt

SEQ ID NO: 63103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaggtcctctctactgtcagtcccctcgc

SEQ ID NO: 63104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgaggttcttgctagggctttgagcttctt

SEQ ID NO: 63105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagtaacgccatggttggttgttacggtt

SEQ ID NO: 63106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagtagggttggtccgctgccctgacatc

SEQ ID NO: 63107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagtatcgctcaccttacgttctctgggc

SEQ ID NO: 63108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagtcattacttcaacctccgggatccta

SEQ ID NO: 63109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagtgtgagagcgtccgtgtcaggtctga

SEQ ID NO: 63110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagtttcggtgatcggcgatttttatgtg

SEQ ID NO: 63111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgagtttggttatgtttatgcacgggttta

SEQ ID NO: 63112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgataaatatgcaggagtgggtttacgaag

SEQ ID NO: 63113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatagctttctcgccggccgcgcttcgat

SEQ ID NO: 63114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatatgtttgcgtggggcggtctcctgct

SEQ ID NO: 63115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatattctgcgttatccttcgtgctcttt

SEQ ID NO: 63116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatcaagcttgcatcgttctcgcttttta

SEQ ID NO: 63117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatcacccgcaactaccttggcaggggtg

SEQ ID NO: 63118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatcattaacatgggttagttgtacacgt

SEQ ID NO: 63119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatcccggtctgttgttacatattatccg

SEQ ID NO: 63120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatccgggagcgtgacatttctgagggac

SEQ ID NO: 63121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatccgttctggtacgcttctatccacgc

SEQ ID NO: 63122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatcgcaacgcgtgagcatgtggccggag

SEQ ID NO: 63123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatctatctggtgtgtattggctgtgatg

SEQ ID NO: 63124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatgagataattcttgctaccacgctagt

SEQ ID NO: 63125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatgatgtttggatggtggtttgaaaggt

SEQ ID NO: 63126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatgctccgagcgaacgcggcatttacca

SEQ ID NO: 63127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatgtcgcttgttgttgtcagtgaggctt

SEQ ID NO: 63128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatgtggttcctactgatagctgctctca

SEQ ID NO: 63129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatgtgtgaccaggccatgatgcctgcac

SEQ ID NO: 63130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgatgttgtttgtggaacttatggtgttgg

SEQ ID NO: 63131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgattgccttacatgataccatgcgacggc

SEQ ID NO: 63132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgattggacatggatgcaggttggttgctc

SEQ ID NO: 63133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaaacagtagtttcctcctacccttcat

SEQ ID NO: 63134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaaatgagccgcgactatcttatttcgt

SEQ ID NO: 63135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaaatgcgtgtgcgtgtatatcgctaca

SEQ ID NO: 63136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaacgttatctgtgacctttctccagca

SEQ ID NO: 63137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaacttgttttgcagggcgcaaccacac

SEQ ID NO: 63138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaagcaccggtaatgttgggcccagctt

SEQ ID NO: 63139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaagtgccgttatggtatcttccggggg

SEQ ID NO: 63140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaatactaacggtttgccagttgttaag

SEQ ID NO: 63141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaatcgccctttggtggcatcccggtta

SEQ ID NO: 63142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaccaagactgcccgtgtggaactccca

SEQ ID NO: 63143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcacccatcacaggcaaaggcgggctccg

SEQ ID NO: 63144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaccgagagcctatgagtcttatcgtca

SEQ ID NO: 63145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcacgagtatgacggagcgttcaccctga

SEQ ID NO: 63146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcacgttgacggttgaaagtcagacactc

SEQ ID NO: 63147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcactcctaattaggttccggtatgttag

SEQ ID NO: 63148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcactcctatggatgaagcttgccaccac

SEQ ID NO: 63149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcactcgctcgctctttactcgatgggac

SEQ ID NO: 63150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcactgacgcaccgtgtcgtgacgagctt

SEQ ID NO: 63151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcactgtggccttacgtttgtgtctcgaa

SEQ ID NO: 63152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcagaattattggggatttcttacgttgc

SEQ ID NO: 63153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcagaccgaacacacacggttgggcggaa

SEQ ID NO: 63154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcagacgctataggctatgccccgcaagc

SEQ ID NO: 63155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcagatgtgagggcgagtggcctgtgccg

SEQ ID NO: 63156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcagcggtcctcagcgttccgatgtaggg

SEQ ID NO: 63157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcagctgtagcacgttcgcgttggcagta

SEQ ID NO: 63158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaggataatttagggtgaaagagccttg

SEQ ID NO: 63159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcagggggcgaatcccggttagttctgtt

SEQ ID NO: 63160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcaggtaaagggagcacacgcagatggag

SEQ ID NO: 63161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcagttggggtggtggggactgggtcggg

SEQ ID NO: 63162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcataacccagttaatgcatttatggcga

SEQ ID NO: 63163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcatactgttaacgtttagaggtagtggc

SEQ ID NO: 63164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcatagcttagggtctggggttattcttg

SEQ ID NO: 63165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcatgctatctatcatcggagtgcgtccg

SEQ ID NO: 63166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcatggccccttttcactaggacgtcgaa

SEQ ID NO: 63167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcatggtgcgcatcagcatgttgtccctc

SEQ ID NO: 63168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcattagcgcttaatgctaaacgtctact

SEQ ID NO: 63169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcattccgaaaggcgaaaagcgccacggt

SEQ ID NO: 63170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgccaccatcctgtgtggtcctccgtgatc

SEQ ID NO: 63171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgccacttacaatgactccggttggtttcg

SEQ ID NO: 63172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgccagcgtgcgcaattgctagcagcaagt

SEQ ID NO: 63173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgccaggcagttaggtaccatcatagtggc

SEQ ID NO: 63174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgccagttcacggtcctggtccttaagctc

SEQ ID NO: 63175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgccagttgaattgtaattactaaggcccg

SEQ ID NO: 63176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgccagttgtaaggtctttcctctggcctt

SEQ ID NO: 63177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcccaagcttcgacacttgacttgcccgc

SEQ ID NO: 63178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgccccagatgtaacgccttcgggtttctg

SEQ ID NO: 63179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcccccgtattttttgtgatgaagtcgcg

SEQ ID NO: 63180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcccccttataccattcatccaatgaggg

SEQ ID NO: 63181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcccctccctctgcgtccccgagctattt

SEQ ID NO: 63182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgccctgtggtcgcgcctgaccggctcccg

SEQ ID NO: 63183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgccgacgttttcccgaagacccgcctgag

SEQ ID NO: 63184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgccgttttaacctctttataaaatctgtc

SEQ ID NO: 63185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcctatctactaagggcatgttaagcggg

SEQ ID NO: 63186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcctcagcccctgacttctacgctcactt

SEQ ID NO: 63187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcctccgttatgcggttttgtgtgtaaag

SEQ ID NO: 63188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgaacgtttccgtccatagacttgggcc

SEQ ID NO: 63189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgaatcggctcgccaatcgccgatgaca

SEQ ID NO: 63190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgacaacggcaaactttgggagcaactg

SEQ ID NO: 63191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgacaaggtgtcccggctggctggtacc

SEQ ID NO: 63192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgagaaggttacgttggagatgtcgcat

SEQ ID NO: 63193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgagacagcccgcgtgtaagcttccaag

SEQ ID NO: 63194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgaggtagcactacggatgctgcaggat

SEQ ID NO: 63195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgagtgagttccaaatcgcgacagcccg

SEQ ID NO: 63196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgattaggtcggtcctttggtgtgggtg

SEQ ID NO: 63197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgattattctcttatgagcacgcttttt

SEQ ID NO: 63198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgcacaaaattataattttatacagtgc

SEQ ID NO: 63199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgcatccaacctgatcgcggtaggttta

SEQ ID NO: 63200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgcatccccaatcgtgtatgcccgctgc

SEQ ID NO: 63201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgcctaggttttgtacgtcgtgcggtga

SEQ ID NO: 63202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgcgaaggacagtcgccggtgtttgcgg

SEQ ID NO: 63203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgcgatcattcaggtgtgtggcggctgc

SEQ ID NO: 63204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgcggcaggtcgactacttactaaaggt

SEQ ID NO: 63205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgctctacctcaagtaactatgcatctc

SEQ ID NO: 63206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgctctcaagtgctcgaattttgtcgct

SEQ ID NO: 63207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgcttccggttgtgatcacggtattgcc

SEQ ID NO: 63208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcggacgtgagtgcaagaggggatggtaa

SEQ ID NO: 63209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcggatttcaacggtacggatatcatggc

SEQ ID NO: 63210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcggcggtacgtccatgttcacaagaata

SEQ ID NO: 63211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcggcgttcggtgcgtttcgatgtgctta

SEQ ID NO: 63212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcggctagcagggtcaccaagtcgttagt

SEQ ID NO: 63213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcggcttaggcggttggcgggcgttttgc

SEQ ID NO: 63214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgggaaggccgtggaaccgttcgtcggc

SEQ ID NO: 63215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgggtcaagcaaaaacaggttatcggtc

SEQ ID NO: 63216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgggttacggtcagtccttattaacttt

SEQ ID NO: 63217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgtaaaataattgtttgtacctgcctcc

SEQ ID NO: 63218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgtacggtatcatgcaattaactgtttg

SEQ ID NO: 63219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgtggattgtattgttttatcttgtctc

SEQ ID NO: 63220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgtgggctaggtcatgatgcgtcgattg

SEQ ID NO: 63221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgtgggtccgtcagctttgtaagggtgc

SEQ ID NO: 63222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcgtgttttacgagccggctgtgtacgct

SEQ ID NO: 63223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctaaccctgtacacccgtccgtcacggt

SEQ ID NO: 63224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctacatatgtcaggagaaccatgcgcgc

SEQ ID NO: 63225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctaccaatatgactggttatcctcctac

SEQ ID NO: 63226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctacctcgcatcatatagtctgtaccct

SEQ ID NO: 63227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctacgatgtgttaacgccctaatggagg

SEQ ID NO: 63228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctactaggtccatcttgttcgagttacc

SEQ ID NO: 63229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctcaagtttatcgatctctccgtgatat

SEQ ID NO: 63230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctcagtgacgagctggtcgctggcttct

SEQ ID NO: 63231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctcatcgttatccgaatgctaagggtat

SEQ ID NO: 63232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctcggttaagccaatagtcgatagcgtt

SEQ ID NO: 63233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctgaactgtgaccggtgctctttctacg

SEQ ID NO: 63234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctgcaagaaagtccaaggatttcgggtg

SEQ ID NO: 63235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctgcctagcgcgcagtttgccttggtca

SEQ ID NO: 63236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctgctgacaatgtttcctgtcaacgtaa

SEQ ID NO: 63237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctggtcctctaagcatgggagtctcgag

SEQ ID NO: 63238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctggtgctcgtcaatcaccacgctattg

SEQ ID NO: 63239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctggtggcgcgtattcgtaatctggtgg

SEQ ID NO: 63240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcttacaatgctgcctcatccactcgtcg

SEQ ID NO: 63241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcttagtttaaatttcgaagtgggctttg

SEQ ID NO: 63242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcttatctccagggagtgcaattggggtt

SEQ ID NO: 63243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcttcatgtatttagtctgcctttttggt

SEQ ID NO: 63244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcttccagaccattatcgtagcttgcgga

SEQ ID NO: 63245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcttccatctcacgtttcgtctgcgcctg

SEQ ID NO: 63246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgcttgccgccaaggccgtatcagtcagtc

SEQ ID NO: 63247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgctttagatgtatgattcctgccttacac

SEQ ID NO: 63248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggaaatggagcgaaggccctcccaaagac

SEQ ID NO: 63249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggaacgctgggcgattgtctggggtccgt

SEQ ID NO: 63250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggaagcaatttggtgtcacaagggacgga

SEQ ID NO: 63251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggaagtagtcttgaccgcttcaatgctac

SEQ ID NO: 63252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggaattgttcgctacatcgcgttcgccat

SEQ ID NO: 63253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggacaaatgtgagtgcagtagctttgcga

SEQ ID NO: 63254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggacaagtaatcagccctacgacgggagt

SEQ ID NO: 63255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggacgattgacggtctcgacaactgctct

SEQ ID NO: 63256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggacgggggctgatttgtcccttagcgcc

SEQ ID NO: 63257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggacggttcatggcttagtacgtgtgtgt

SEQ ID NO: 63258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggacttggtacttcatcctttgtatcttt

SEQ ID NO: 63259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggagagacatcactcgggttcagcgacac

SEQ ID NO: 63260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggagatcgagttgataaatcgaccgacgt

SEQ ID NO: 63261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggagccgtgtttgttatgttgatcggtct

SEQ ID NO: 63262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggaggcgtaaacgacgttggtccttgtgc

SEQ ID NO: 63263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggataagcagaatgcgacctctgcgttgt

SEQ ID NO: 63264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggatagctaggcttagaagttcggttgtg

SEQ ID NO: 63265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggataggggggttgccatcagggtgagta

SEQ ID NO: 63266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggatccgacgaatttctgaagcttggtga

SEQ ID NO: 63267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggatcgttggactcttgactcccaaatct

SEQ ID NO: 63268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggatgggggaacacattgcgcgatagcac

SEQ ID NO: 63269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggatgtacgcactgcctcgcatcggggac

SEQ ID NO: 63270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggattcggataagctgcccccgaactatc

SEQ ID NO: 63271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcaaacccatcctttgtcatccaggtcg

SEQ ID NO: 63272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcaaagggcgtgtttcttttcggcatcc

SEQ ID NO: 63273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcaacacggatgggtttagggttgagca

SEQ ID NO: 63274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcaattttggtgcggaaccgactacctc

SEQ ID NO: 63275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcacgctcgctgtgacccggtcgttgat

SEQ ID NO: 63276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcagagctcggccattacgtgacgcgcg

SEQ ID NO: 63277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcatatttagcttctggcatttggggct

SEQ ID NO: 63278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcatggccataaagccaggggttgcgcg

SEQ ID NO: 63279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggccaaaatcaatgcagttgttaaggatt

SEQ ID NO: 63280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggccacaagaaggtactggcgtgctccat

SEQ ID NO: 63281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggccaccagggtggaggagggatccggat

SEQ ID NO: 63282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggccacctcggcgtgacgttggggatggg

SEQ ID NO: 63283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggccacgtatacatgagctgtcacaaccg

SEQ ID NO: 63284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcccaagtcgtctgaaacatgggggcac

SEQ ID NO: 63285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcccgatctcctttttaaattgaaccgg

SEQ ID NO: 63286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggccgatcagcgcgacagatcttgcagcc

SEQ ID NO: 63287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggccgctcggggttgctctacacggacgt

SEQ ID NO: 63288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcgcaacaacgatgttcaggcgacgggt

SEQ ID NO: 63289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcgcacgttagcaatccacagccgcatt

SEQ ID NO: 63290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcgccactcctccactcgcagattctca

SEQ ID NO: 63291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcgctacttcatgtggaaaccctagttg

SEQ ID NO: 63292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcgcttctaattttactctgagtgtgag

SEQ ID NO: 63293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcggaatccaggttagcccagttttccc

SEQ ID NO: 63294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcgggctaagtccaactcgtgcactttt

SEQ ID NO: 63295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcgtaagcgagcgccccgtaactttgtg

SEQ ID NO: 63296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcgtctaaaatcgattgggcacgttcgc

SEQ ID NO: 63297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggctatcgtgcccatcgattggaccgacg

SEQ ID NO: 63298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggctatgtgctggcaggagtgggccgaac

SEQ ID NO: 63299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggctcagagctgttttaaggtgtcggagc

SEQ ID NO: 63300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggctcggttctgggtgcatgggaggttac

SEQ ID NO: 63301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggctgaccgactgtcgattgttgagcggc

SEQ ID NO: 63302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggctggtggatgaccttgccgcatccgct

SEQ ID NO: 63303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggctgttgggggctacaaatcgggtgcga

SEQ ID NO: 63304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggctgttgttgcaattcctagtgttcccg

SEQ ID NO: 63305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggcttgcctagtacaagtcagtaaattgc

SEQ ID NO: 63306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggctttaggaggaccccacgggccatagg

SEQ ID NO: 63307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggaatgccactctaggacatgggggctc

SEQ ID NO: 63308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggactgtactcttccatctgcggatttt

SEQ ID NO: 63309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggactttggtgttgcagtcatatgatta

SEQ ID NO: 63310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggagccaagaagttgttcgtgatggagg

SEQ ID NO: 63311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggagctagttcgcacagtttgcgatatt

SEQ ID NO: 63312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggagggggaggccggtaccaccgagcac

SEQ ID NO: 63313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggagtacaagctaatctcgcgcacacgt

SEQ ID NO: 63314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggagtcaccccaaccatggcactggaaa

SEQ ID NO: 63315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggagtcgttctggtgtaccggacagttg

SEQ ID NO: 63316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggagttagatctagtgcccaaggcatac

SEQ ID NO: 63317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggagttcagatgagatatcgtcacgctc

SEQ ID NO: 63318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggatcagaacgttcgactctaagtgtgc

SEQ ID NO: 63319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggatgcaacagtgtgtatgcttagtcac

SEQ ID NO: 63320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggcaggtacgtgtcactaacgattgagg

SEQ ID NO: 63321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggccagggtggatagttgctcggtttgt

SEQ ID NO: 63322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggccagtcaggtcctgccgtgctacttg

SEQ ID NO: 63323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggcccggcgaggttacccggtttcggtt

SEQ ID NO: 63324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggccgcgaacgactgaattcattcgttc

SEQ ID NO: 63325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggccgtgcgggccatgttttgccgggta

SEQ ID NO: 63326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggcgatccttgttactgctgccgtactt

SEQ ID NO: 63327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggcgcctgagagcttgggagatcattca

SEQ ID NO: 63328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggcgtcggagtttctcggtgttgattac

SEQ ID NO: 63329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggctagccttagttttcttggatgcgtg

SEQ ID NO: 63330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggctcagttccatacggcgctgaaaaca

SEQ ID NO: 63331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggctgagatggtggacagtacgacggca

SEQ ID NO: 63332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggctgagtgttcctgcgagccacttgtg

SEQ ID NO: 63333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggctgtttagcacccagctcgacgagtg

SEQ ID NO: 63334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggcttcagggatactttgtgaccgtggg

SEQ ID NO: 63335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggggaccagctcaaccaaactatgcgaac

SEQ ID NO: 63336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggggaggtggtcggcggctgaggcggagg

SEQ ID NO: 63337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggggcaccttgcagacgatgatgcggttg

SEQ ID NO: 63338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggggagaaattcaatacgctcaacttag

SEQ ID NO: 63339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggggcgcagtttcttagtcccacttacg

SEQ ID NO: 63340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggggcgcgcgtcccggtctgctttatct

SEQ ID NO: 63341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggggtgggcttttctactgttttggagc

SEQ ID NO: 63342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggggttaacagagcgcagcgcaacggat

SEQ ID NO: 63343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggggtcatgtgggtatgctcactgggggc

SEQ ID NO: 63344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggggtctgcttgcccaagtcatacatgac

SEQ ID NO: 63345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggggtttattgcgtcagatttgtgttgat

SEQ ID NO: 63346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtaacccaaacgccacaaacgcgggct

SEQ ID NO: 63347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtacggcatgtttattcggaatagtgc

SEQ ID NO: 63348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtagtcgcacggtacatcagccgacct

SEQ ID NO: 63349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtcataaaagtacacgtccgggggtgg

SEQ ID NO: 63350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtcgcgttactgacattgaatccgggt

SEQ ID NO: 63351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtcgttgtcgtaaatcttcgattctcg

SEQ ID NO: 63352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtctggtgggattaagatgtaccgttc

SEQ ID NO: 63353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtctttcgtacgggctctggtccttgt

SEQ ID NO: 63354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtgcctgggtctgcatttactgctggg

SEQ ID NO: 63355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtgcgtaactcaataaccagtacttcc

SEQ ID NO: 63356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtgctgaactcacactttgctggatgt

SEQ ID NO: 63357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtggctgggatatttcgccagagtata

SEQ ID NO: 63358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggttcatttctttaagaagcctcagttc

SEQ ID NO: 63359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgggtttgtatgtgggggcatgtgtctggc

SEQ ID NO: 63360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtaagcacgagatcttaacttgcgcacc

SEQ ID NO: 63361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtaagcggcgtagagctacgttatgccg

SEQ ID NO: 63362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtaagcttgaatggaccaatcgatttgc

SEQ ID NO: 63363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtacaatgcgtgtcacatataaaaattc

SEQ ID NO: 63364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtagactgggatatacggccgctgctcg

SEQ ID NO: 63365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtagtacagaggaattactgatgtcttg

SEQ ID NO: 63366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtatcctcgacccaagttttgttaagtc

SEQ ID NO: 63367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtcacgcgaatattcccagccgtgtgga

SEQ ID NO: 63368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtcatccagttttaggggcagtgacagc

SEQ ID NO: 63369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtcatgattatggactgcacgttttccg

SEQ ID NO: 63370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtccaaaggtagattgggttgcacggtg

SEQ ID NO: 63371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtccggctctgggtctgtccacgctggt

SEQ ID NO: 63372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtccttgactgtaacccgttgcgtaagc

SEQ ID NO: 63373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtctcccaattcgtgaatatcggcctgt

SEQ ID NO: 63374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtctgggcgctgcgggtctagtggtatg

SEQ ID NO: 63375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtcttgctagcgacgcttgagctatgcc

SEQ ID NO: 63376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtgacatccgatacgtgagcttagatgc

SEQ ID NO: 63377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtgatgaagagaagcgatattgccttcg

SEQ ID NO: 63378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtgcaagggatcgggtcggacacctgga

SEQ ID NO: 63379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtgcggcagcaggctcagttagcgcact

SEQ ID NO: 63380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtggtgcactatctaatacggcaccttc

SEQ ID NO: 63381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtgtcggttggaaacacgtaaaattgct

SEQ ID NO: 63382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtgtctagtttacgatgatccggttagt

SEQ ID NO: 63383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtgtgttaattggctttcgagagcagct

SEQ ID NO: 63384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggttaccctgcaataacactgtgttgtgc

SEQ ID NO: 63385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggttgcgcgaagcggttcgttcctccggc

SEQ ID NO: 63386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggttgggatttgtgcacatatcactttaa

SEQ ID NO: 63387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggttgggggaggatgggacgactttctat

SEQ ID NO: 63388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggttggttcctggtgtacattcgtggtat

SEQ ID NO: 63389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggttgtgccaaaactggtatttgtcctct

SEQ ID NO: 63390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccggtttcctcggcgtgtcttattaggcggt

SEQ ID NO: 63391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtaaatacgcatggcgtgtgaccatcccg

SEQ ID NO: 63392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtaaattggggggaacatttcattttatc

SEQ ID NO: 63393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtaagtcccttgaggcggtgactgcataa

SEQ ID NO: 63394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtaatttgaatttttcgccttgagtttgg

SEQ ID NO: 63395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtacaacacatgctcgtccgccgttcttt

SEQ ID NO: 63396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtacctcagcagggcatagcacaattagt

SEQ ID NO: 63397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtacctttcgcgactcgtctaggtttcgc

SEQ ID NO: 63398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtacgattggtggtcggtggtggtcctgc

SEQ ID NO: 63399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtacgctcgttatcttgccaagggatcgt

SEQ ID NO: 63400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtacgtcaacatcgacacatcatgccatc

SEQ ID NO: 63401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtactaggagcatagcgatcttcggtgtg

SEQ ID NO: 63402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtactggcactgcaaacatagttgtggaa

SEQ ID NO: 63403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtacttgtgttgttgtgctagttttcaag

SEQ ID NO: 63404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtactttagaggcctcaaatcgatctcgc

SEQ ID NO: 63405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtagcaggtgcccatcgtgttggtgggtg

SEQ ID NO: 63406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtagtcatacgaaggtcctagcctgcctg

SEQ ID NO: 63407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtatagatatccagctttttggtggtggc

SEQ ID NO: 63408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtatatccacatggacagccgtacgattc

SEQ ID NO: 63409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtatatgacttacctcagggcgggatctt

SEQ ID NO: 63410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtatcgctcccagtccggatgtctgaatt

SEQ ID NO: 63411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtatggctaggttttcagcggccgaacgt

SEQ ID NO: 63412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtatgtagtctttcgatcgctgtgcggca

SEQ ID NO: 63413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtatgtgactatgcgcggcgaacgtatcg

SEQ ID NO: 63414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtattacctgtagacgttcatgaggttgg

SEQ ID NO: 63415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtattggtatgttacgtatgctcgtgggc

SEQ ID NO: 63416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtattgtggggctcaacatcgcgttgtct

SEQ ID NO: 63417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcaagccccaacatgctcgagccaattt

SEQ ID NO: 63418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcaggattaattcccgcaacgggagggc

SEQ ID NO: 63419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcagggtctcttggcggtggaaaggggc

SEQ ID NO: 63420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcatccgtcggctttactctgctccccg

SEQ ID NO: 63421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcattgatttccttcgcgctatgggatt

SEQ ID NO: 63422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtccagccagcttaacattagcaggtgca

SEQ ID NO: 63423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcccacgattagacggtatgcccctcgc

SEQ ID NO: 63424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcccagcgtgccaagccgccagactggg

SEQ ID NO: 63425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtccctgtcagcgtcgcttggcaactcta

SEQ ID NO: 63426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtccctttccatcatatatagactataag

SEQ ID NO: 63427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtccgggcgaactcacgggattggatggc

SEQ ID NO: 63428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtccgtgtctatgcgagtctagctgtccc

SEQ ID NO: 63429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcgaagttataggtcaatcgggtccgtt

SEQ ID NO: 63430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcgagggctcgagcactccgcttttaca

SEQ ID NO: 63431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcgatagcagaagagttactcgttatgt

SEQ ID NO: 63432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcgccaaagtaacagacagggattagtt

SEQ ID NO: 63433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcgctgatgttgagttggtggttagtcg

SEQ ID NO: 63434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcgggcaggacctgcaaagggctaagcg

SEQ ID NO: 63435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtctacgtttgggaatcaatcaagcctgt

SEQ ID NO: 63436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtctaggccccggagttactcggacgggt

SEQ ID NO: 63437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtctcgagcttaattctttcgatgcgctg

SEQ ID NO: 63438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcttacgggcattttggcgctctcacac

SEQ ID NO: 63439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcttagattccgctttagcctccgtgtg

SEQ ID NO: 63440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtcttgaattgtgatcgaagtgggtaatt

SEQ ID NO: 63441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgaacgtgtggcagagttgcgctactgc

SEQ ID NO: 63442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgagtaagcgtgatttagttctgtacta

SEQ ID NO: 63443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgatacatacagcctgcaccgtttgtcg

SEQ ID NO: 63444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgatttctgatcatgtgcaatgattttt

SEQ ID NO: 63445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgcagactagtttagccagttttaggtt

SEQ ID NO: 63446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgcatgataaattggtacagggaggtgg

SEQ ID NO: 63447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgccagctgccctcctcatcttcccgcc

SEQ ID NO: 63448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgccgaaggtgattatacacgcagcgtc

SEQ ID NO: 63449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgcgcaaggccttagccacctgaaccgt

SEQ ID NO: 63450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgcgctcatattaaaactatgcgggttc

SEQ ID NO: 63451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgctagagttcttctcatcgcgtccttc

SEQ ID NO: 63452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgctagggttataagtgcatcttcactt

SEQ ID NO: 63453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgctcagtgatggcctaccttgtacgtg

SEQ ID NO: 63454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgcttcgggtcgtggatgcacttgtcca

SEQ ID NO: 63455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggagcttcaagctgttcccagcgtctg

SEQ ID NO: 63456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggatgcggcagatcacgtcaacggggg

SEQ ID NO: 63457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggcacccgcagataacaaggtattaac

SEQ ID NO: 63458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggcacgtgtcttggaggctccgacagt

SEQ ID NO: 63459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggcgcgcgattcaccctcgtgacccct

SEQ ID NO: 63460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgggacaggtcgccggctgctttttatc

SEQ ID NO: 63461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgggcgggttgcgaaattacgcggctta

SEQ ID NO: 63462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggggccggtatcccgtatcacgtggtg

SEQ ID NO: 63463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggggcgagtcaatatgacggagttatg

SEQ ID NO: 63464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggggtacaagggtgggcccccaagtgt

SEQ ID NO: 63465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggtcaatttaggggtttaggcgagttg

SEQ ID NO: 63466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggtggcagaggctagttgattgcatga

SEQ ID NO: 63467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtggttaatgagggtcatgatcgaaacat

SEQ ID NO: 63468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgtaatagaccagtcatcatatccctca

SEQ ID NO: 63469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgtagttatgatgggggagccgtgttcc

SEQ ID NO: 63470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgtcaagattgcgtgtttccgtgggttc

SEQ ID NO: 63471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgtcccgcttagcgattcttgggaggat

SEQ ID NO: 63472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgtctgggactgtttgttcatgggcaag

SEQ ID NO: 63473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgtgacttcagcgtgaaggcaagtgcgc

SEQ ID NO: 63474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgtggcggtagtttaagcattgcaccgt

SEQ ID NO: 63475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgttggcgacgatgtcctgattgtcttg

SEQ ID NO: 63476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgttggtcttgtgttctttatcatgaca

SEQ ID NO: 63477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgtttgagatctgagtggatagtctggg

SEQ ID NO: 63478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtgtttgggccaagcttacgttcgggtcg

SEQ ID NO: 63479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttaacaggcatgaatcgcataggattca

SEQ ID NO: 63480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttaacggcatggattacgataaggacca

SEQ ID NO: 63481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttaagatagaaattgccgcgctcggacg

SEQ ID NO: 63482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttacagtgtgttagcgaggaagtgttgt

SEQ ID NO: 63483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttagcacataagaggtccgttcccatgg

SEQ ID NO: 63484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttagccctctacggttcactgtgtcggc

SEQ ID NO: 63485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttcactggggatgtgcaactctttggta

SEQ ID NO: 63486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttcagacaagcctcatgttagatggccc

SEQ ID NO: 63487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttcagactcccagctccctgaatacggc

SEQ ID NO: 63488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttccgtaaattgttggacgcgggagttg

SEQ ID NO: 63489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttccttatgtgttgtggaggaatcgtct

SEQ ID NO: 63490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttctttcgagcttgattccgttggtggg

SEQ ID NO: 63491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttgaatcttttaacgctttaactacttt

SEQ ID NO: 63492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttgagcaggttcaacctctgttcgagag

SEQ ID NO: 63493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttgaggtttgagtttctcgtctcattgg

SEQ ID NO: 63494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttgcaggccacgttcgctttcttggcgg

SEQ ID NO: 63495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttgtcgaggcctccgtcggtagcatatt

SEQ ID NO: 63496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtttaacctgaaggaagcctcgtgttgtt

SEQ ID NO: 63497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtttccaaggagcgcccagaccttcttct

SEQ ID NO: 63498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtttcgaggaatggatggattctccatcg

SEQ ID NO: 63499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtttgcgatgcctagttttccgataggcg

SEQ ID NO: 63500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgttttctggggcgtgataacgcaattgtc

SEQ ID NO: 63501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccgtttttctagttgatattgatccacggca

SEQ ID NO: 63502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaaaccaacggttactttgggtgaacgcg

SEQ ID NO: 63503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaacacacacgagtaaccatcttgtccac

SEQ ID NO: 63504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaaccagctcggtaccttgtctccacacg

SEQ ID NO: 63505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaagaatgagatcaaacgtggccggaatt

SEQ ID NO: 63506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaagacattgcgtagagaaggtagaacgt

SEQ ID NO: 63507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaagagaacgctgcatgcttgcctcactg

SEQ ID NO: 63508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaagggtggattgcggttcaggtttgtac

SEQ ID NO: 63509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaaggtgctgaagtttatagcctgattgc

SEQ ID NO: 63510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaagttaattatgcgctgagagtatgtct

SEQ ID NO: 63511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaagttcggtcgaggccgccaacggagat

SEQ ID NO: 63512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaatgcagtcaacagaatactggccgtcc

SEQ ID NO: 63513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaatggacgcgacgaacaactacgaaatt

SEQ ID NO: 63514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaatggcactaggcgggtaacgctggtat

SEQ ID NO: 63515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaatggtctgtcgttgctgtcctttagac

SEQ ID NO: 63516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaatggttatcgaaggataatagcctctg

SEQ ID NO: 63517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaatgtcactaggacaagtttcattgatc

SEQ ID NO: 63518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaattcaagtgtctggagaactggttaga

SEQ ID NO: 63519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaatttgttatagtgactgtaatcgctct

SEQ ID NO: 63520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacaagcagacatgttaagggggaggtgt

SEQ ID NO: 63521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacacggaggtcctaacccaggctggatg

SEQ ID NO: 63522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacattcattgttggccaaggtttcttgg

SEQ ID NO: 63523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacattcccgctgacgtctggtcccagtt

SEQ ID NO: 63524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaccatgtgccaactgaactggtacgccc

SEQ ID NO: 63525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacccgacgacgaacaagggtcccgagcg

SEQ ID NO: 63526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaccttcagactgtgtggcttacagtttt

SEQ ID NO: 63527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaccttgaagagttcggggtatgcctgga

SEQ ID NO: 63528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacctttagctggatcaattgaccgcctt

SEQ ID NO: 63529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacctttgtcatcgcggacgaatccgttc

SEQ ID NO: 63530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacgagtggacgtaccatgcgagaatcac

SEQ ID NO: 63531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacgcacgcacttagccgccttccaggat

SEQ ID NO: 63532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacgcagcgatcgatacacttctgcacgc

SEQ ID NO: 63533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacgcatcttctgccccgccatttataga

SEQ ID NO: 63534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacgcgcaaggcgttctgctgtctcgtta

SEQ ID NO: 63535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacgctccaggttcttccgctatagggcg

SEQ ID NO: 63536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacggggtgggcggggatcctcaagctgc

SEQ ID NO: 63537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctacgtccttgcggttagccatccgccctt

SEQ ID NO: 63538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctactatatacggtttccctatgggactgg

SEQ ID NO: 63539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctactatgtggtctgactgtcggctcgcta

SEQ ID NO: 63540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctactcaggttgggttatgacttatggacg

SEQ ID NO: 63541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagagtacttccggtggcgtcatggccgt

SEQ ID NO: 63542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagattcttactgtaattgggtttgcggg

SEQ ID NO: 63543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagcatacgtaattcttggtttcgtgacg

SEQ ID NO: 63544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagccacatggggtgtaactctcacattc

SEQ ID NO: 63545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagcctggctggattactctaatcccctc

SEQ ID NO: 63546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagccttcttcacctcaccaagtaagctt

SEQ ID NO: 63547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagcgatcccgagatgtcagtgagcttct

SEQ ID NO: 63548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagctttgctacagagttgtgtgcagaat

SEQ ID NO: 63549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaggccgtacctcacccgtccgaagagcc

SEQ ID NO: 63550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaggcttccaccgctcttgtagcgttcta

SEQ ID NO: 63551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaggtcgaggtcaactgtagacgtgccga

SEQ ID NO: 63552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaggtgggaggaaccgcttgtaaattgcg

SEQ ID NO: 63553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctaggtgggcgtttataatggactttgacg

SEQ ID NO: 63554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagtaaacgcgcggttcagggaggtaacg

SEQ ID NO: 63555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagtagaacctaggatgtaatgccaacgc

SEQ ID NO: 63556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagtcagattaattccttaggttagaatt

SEQ ID NO: 63557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagtccgtcccatgtccatgctcacctgc

SEQ ID NO: 63558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagtctggcggggacatctacctattgga

SEQ ID NO: 63559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctagttatggtgttgccatcacgctcgcct

SEQ ID NO: 63560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctataaggattatggatttatccaagcttc

SEQ ID NO: 63561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctatatgggtctgtactacatggtccggtc

SEQ ID NO: 63562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctatcgtcaaccgcgtcggcaatcgtcttc

SEQ ID NO: 63563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctatgagttttaatatagtttctgtgttac

SEQ ID NO: 63564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctatgatcctaatccactctttcaagaaga

SEQ ID NO: 63565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctatggttactggtgctgtgtgaaatgccc

SEQ ID NO: 63566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctatggttaggctttcaactggtgttgggt

SEQ ID NO: 63567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctattgtaggttcgggctagagcgtgataa

SEQ ID NO: 63568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctattgtagtgctgtaaagcggaacacttt

SEQ ID NO: 63569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctattgtgacatgggctattgaagcgtccg

SEQ ID NO: 63570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctatttgagtccggcgaggtctatcggcca

SEQ ID NO: 63571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcaacgatttttatcgcagtgcttctagg

SEQ ID NO: 63572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcaagcgggtaaatagacatcgtactatt

SEQ ID NO: 63573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcaagtcaggatcccagcatcttgggccg

SEQ ID NO: 63574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcacgaatgtgactgacgtggggttttac

SEQ ID NO: 63575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcacgagtaagcgttttcttgggttcatg

SEQ ID NO: 63576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcacgcaagttaggcagttagtgctcgac

SEQ ID NO: 63577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcacgctccagtagttccatgattgagcc

SEQ ID NO: 63578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcactggcccggcgtaggatgcagatact

SEQ ID NO: 63579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcactttcaacacataccggcgctgcatg

SEQ ID NO: 63580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcagcggatggatgcatggctgataggcc

SEQ ID NO: 63581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcaggaggatttctctagccacactggga

SEQ ID NO: 63582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcatgtagtgacttcagacattggcatgg

SEQ ID NO: 63583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcattacgttaactcaagttttcaagtga

SEQ ID NO: 63584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcatttagcgacttcttgtgctagccgtt

SEQ ID NO: 63585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccaaatattatagctcaatcggacgcaa

SEQ ID NO: 63586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccaacttctctcggaatgcaaggccgta

SEQ ID NO: 63587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccatgtacattgccacagcgccaggcaa

SEQ ID NO: 63588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcccaactttagctgcttgcagagggtcg

SEQ ID NO: 63589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcccacgccagggcacgtatgtaatggtc

SEQ ID NO: 63590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcccctgcatccccactttactcggcgcg

SEQ ID NO: 63591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccgctgaggggcgtgcatcgactccttc

SEQ ID NO: 63592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccgtcttaaatgatggctagtctttatg

SEQ ID NO: 63593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcctacgcttgtgcgcatcctatgctctc

SEQ ID NO: 63594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcctgtaccgcgttaacaggaatctcaac

SEQ ID NO: 63595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctccttgtttgcttttctgtgttatcaagg

SEQ ID NO: 63596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcctttctacaatgcgacttccgtgctta

SEQ ID NO: 63597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgaaaatactctgcaagttaggcactga

SEQ ID NO: 63598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgaaactctacgagctgtttattgatac

SEQ ID NO: 63599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgaatatttgtccccaccgttttctgtt

SEQ ID NO: 63600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgaccctgggaaggttgcgcgggccacc

SEQ ID NO: 63601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgacggcatattacttatccaccggctg

SEQ ID NO: 63602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgcgctcaagcatccggttgctggacta

SEQ ID NO: 63603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggaagggctgaatctgattacgggttc

SEQ ID NO: 63604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggacttattgcgtactttgacacgttg

SEQ ID NO: 63605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggagtcatacagatgttagcgttcgtt

SEQ ID NO: 63606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggcaatgacccgaccggttgcgaggcg

SEQ ID NO: 63607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggctatcgtagttcgctagcgtatcac

SEQ ID NO: 63608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggctgggtgcgatcatgtatttggcgg

SEQ ID NO: 63609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgggatttgaggcccgataaaacggccc

SEQ ID NO: 63610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgggctttaacttaaagggagccttatt

SEQ ID NO: 63611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggggtttactgaacgtggagcatgttg

SEQ ID NO: 63612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggtctatgaagggtaacgttagcctcc

SEQ ID NO: 63613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggtggcgccatgtgctacactggagtc

SEQ ID NO: 63614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcggttgggcgtcgagagtaaggctgcaa

SEQ ID NO: 63615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgtacgtccccgatggaggccacatatc

SEQ ID NO: 63616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgtagcagtgcggcaatcttgtgtgagg

SEQ ID NO: 63617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgtagcgtctcactttgttttatcagtc

SEQ ID NO: 63618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgtcgcaaacccaaagggcttgtgtctg

SEQ ID NO: 63619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcgttcatgtaaatctggtgccacgccgc

SEQ ID NO: 63620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctatacgatccgttattgattaagaact

SEQ ID NO: 63621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctctgccaagctgtcacgcctcatcgac

SEQ ID NO: 63622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctcttcacggattgcccagtggtaaggc

SEQ ID NO: 63623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctgatgatcggcgataaagtttgcgatc

SEQ ID NO: 63624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctgattacagcagcaagagatctgggac

SEQ ID NO: 63625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctgcccctgtatggatagcgcgagtggt

SEQ ID NO: 63626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctggaggccgttgacctttttgcttcaa

SEQ ID NO: 63627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctggcgatcgcataatgtcccgcacgta

SEQ ID NO: 63628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctggtttcctggttctgttcccgcgcgt

SEQ ID NO: 63629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctgttcggcgattgtaggatgatcgggt

SEQ ID NO: 63630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctgtttcgggatcttatgtgcgcaggta

SEQ ID NO: 63631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcttacagtctgagtctcgacgtcctaaa

SEQ ID NO: 63632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcttacgtgctgtacagccaactgttccg

SEQ ID NO: 63633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcttatagcgaattgttacccggagcagg

SEQ ID NO: 63634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcttccatatgagttatctggctactccg

SEQ ID NO: 63635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcttctattcgagcgaactttgattgtct

SEQ ID NO: 63636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcttgccgtctccgcacgacattggatgt

SEQ ID NO: 63637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctcttgtttaggcgacaatgtacattgacc

SEQ ID NO: 63638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctttagcccggtgtgaccagcgcgaagg

SEQ ID NO: 63639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctctttcgggctgctatgagggaatctctt

SEQ ID NO: 63640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgaaagggcatgtggttcgcgtttcgatt

SEQ ID NO: 63641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgaaatcgataaaaaccctgtcttaatcg

SEQ ID NO: 63642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgaaattcgaagagcaagagtctgcgaag

SEQ ID NO: 63643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgaacatttatagagtaagccttcaggtg

SEQ ID NO: 63644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgaagaggccgcatgagggttctctttcg

SEQ ID NO: 63645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgaatgtgtctctcattctgtagagctct

SEQ ID NO: 63646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgacactaggacgtcgttcttacaccgcg

SEQ ID NO: 63647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgacgaaaccatgcactaagtacgctccc

SEQ ID NO: 63648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgactcctgggcgactcactggcaacagg

SEQ ID NO: 63649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgagccgcgctgacccataacgattcgtg

SEQ ID NO: 63650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgagcgtatactactcgtgtctggttctc

SEQ ID NO: 63651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgaggtattaagctgggggcaacaactag

SEQ ID NO: 63652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgagtgattccatatgcacccaacatgtg

SEQ ID NO: 63653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgataaaacggttgttatcctctattcgg

SEQ ID NO: 63654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgatccccacataaataaacaaggacaaa

SEQ ID NO: 63655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgatcgtgttcttgtgtccctcatgttgt

SEQ ID NO: 63656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgattgcgcggacattgcacggttccaaa

SEQ ID NO: 63657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgattgggcattcctctcgtctggcttcc

SEQ ID NO: 63658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcaaaaccagcatatgcgtcaccttcgg

SEQ ID NO: 63659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcacgtagcgagggtggaagataggggt

SEQ ID NO: 63660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcacgtcatgcgttttgccgcgagcacg

SEQ ID NO: 63661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcacgttaccagtttgtcaccttcgcac

SEQ ID NO: 63662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcagtgctcacggtggctgtgtattgtc

SEQ ID NO: 63663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcataacagtctggcagcctctggggaa

SEQ ID NO: 63664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcatatattccaccgtcattacatttgc

SEQ ID NO: 63665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcatctagctagacttattttggagttt

SEQ ID NO: 63666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcattccagcggtgtctcccttcatggg

SEQ ID NO: 63667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcattcgtcactgaataacgagggccac

SEQ ID NO: 63668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgccaattgactccgatgttcatctcata

SEQ ID NO: 63669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgccagcaatccctgcgaaactgagtggc

SEQ ID NO: 63670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgccgtgcatccaggtcttgtctggtagc

SEQ ID NO: 63671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcctcagtcctgaacacatccctagaag

SEQ ID NO: 63672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcgcaacgatgcgtctgggaagtttctg

SEQ ID NO: 63673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcgcacgcgcgatcttcggttacccgcc

SEQ ID NO: 63674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcgccaagtggctatggtagcttcgtca

SEQ ID NO: 63675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcgcgtctgttcccagtatgcgctgcgc

SEQ ID NO: 63676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcgggcctcatcgggataatatctggag

SEQ ID NO: 63677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgcggtttgctatacacgttgtggcccgt

SEQ ID NO: 63678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgctaggcccagcaggagtttgtaaaata

SEQ ID NO: 63679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgctctcgaacacgcacaagtgattagtt

SEQ ID NO: 63680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgctgatgccgtcatccaagtctcccggt

SEQ ID NO: 63681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggaagcacgtctcacagtgtcggcgggg

SEQ ID NO: 63682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggaagtcgtaagcgtgcggaaatccctc

SEQ ID NO: 63683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggatggccaacttctgagtgtgctgttt

SEQ ID NO: 63684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggattaatatacgcgtttccatgacgta

SEQ ID NO: 63685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggattacattcttgaccttatcttggta

SEQ ID NO: 63686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggcaaagtaaaatcatttgcactagcac

SEQ ID NO: 63687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggcacagagctaactgggaatattgtgg

SEQ ID NO: 63688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggccgcacaccggggcattgccagggtt

SEQ ID NO: 63689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggccgtgttagggcctgctgtaaaaact

SEQ ID NO: 63690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggcctagcccgtgcgcaacccgtgcagg

SEQ ID NO: 63691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggccttctcagcgatgccgtttcccgca

SEQ ID NO: 63692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggcgtttgttaccaaaggacgttgggtc

SEQ ID NO: 63693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggcgttttcttgtcttctgttcttccgt

SEQ ID NO: 63694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggctatagggctcggtcgttcgtagcgg

SEQ ID NO: 63695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggctcggctgtcgggttgtaatgcccgc

SEQ ID NO: 63696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgggaaatcgactagcgcttttggtttgg

SEQ ID NO: 63697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgggaactttatcttctatttttattctc

SEQ ID NO: 63698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgggaggtggtgtgacgactggccatgcg

SEQ ID NO: 63699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgggatcacaatgttcacgctgatactaa

SEQ ID NO: 63700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgggcaactcggttctggttaccccatgt

SEQ ID NO: 63701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgggcgggtttccggtgtataacactttg

SEQ ID NO: 63702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgggggttggttcagtggccatctgttca

SEQ ID NO: 63703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggggtataaaaacgcgctgaagacggag

SEQ ID NO: 63704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgggtatcacggtcatgagctcttggttc

SEQ ID NO: 63705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgggtggggattcaagcaaactgtgtccc

SEQ ID NO: 63706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggtaagcagcttttgttcatgcgggagg

SEQ ID NO: 63707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggtagtgtactgatagcaagttaaacgc

SEQ ID NO: 63708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggtatccatcctctcctgcaactgtagg

SEQ ID NO: 63709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggtccagtgcgaagttctacattattgt

SEQ ID NO: 63710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggtcgctcaactgttgtaccctgccttg

SEQ ID NO: 63711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggtgtctccactgatgaatttaacgatg

SEQ ID NO: 63712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggttagcagctcagcgcagtccgaacgt

SEQ ID NO: 63713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggttcacgtatcctttgtgttaccgtgt

SEQ ID NO: 63714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctggttggcctgatgtcggtccatgataga

SEQ ID NO: 63715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtagagttgctttcatcttggctcggct

SEQ ID NO: 63716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtattctaggagcacctagtgttattcg

SEQ ID NO: 63717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtctaacatctaatgtggtgttaaagcg

SEQ ID NO: 63718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtctctcgttcggtagattgtccgcttc

SEQ ID NO: 63719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtgcagatacaaccatcattgccggagt

SEQ ID NO: 63720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtgcatgcggtgggttattccggccgac

SEQ ID NO: 63721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtgcgctaaggcggataacggggagtgc

SEQ ID NO: 63722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgtgtaggttcgcgagttttttgcttgcc

SEQ ID NO: 63723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgttaggggggttgttggcacttggatct

SEQ ID NO: 63724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgttgcacatcaggtcgtgtgagaaggct

SEQ ID NO: 63725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctgttgcataagtgctggggtattctgacc

SEQ ID NO: 63726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttaaacgatccatatggcattcccggtaa

SEQ ID NO: 63727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttaatcgtgcgcgtgcagtggtccaccat

SEQ ID NO: 63728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttacctaatcgccgtcctaccgccacgtt

SEQ ID NO: 63729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttaccttcatacttcaggcaattggtttt

SEQ ID NO: 63730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttacgtattatcttgtgtagaaggtttat

SEQ ID NO: 63731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttacttcgggcgccttctgggacacatca

SEQ ID NO: 63732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttagagaaatagtttagaacgcattaaat

SEQ ID NO: 63733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttagggattggctaggatttttgtacttc

SEQ ID NO: 63734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttataacctcccttgtatcggaggacaaa

SEQ ID NO: 63735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttatcatcgttcgtacctgcttaagggtt

SEQ ID NO: 63736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttatccttgcgggagacatgacgaggaac

SEQ ID NO: 63737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttatgacgcgtccgtcgcacactcgatcc

SEQ ID NO: 63738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttattcggaggcccagacgcgtgcatcgt

SEQ ID NO: 63739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcacctattctttcgcggtattacttac

SEQ ID NO: 63740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcactacttgaacttatttgggagaagt

SEQ ID NO: 63741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcaggagtaggtgcatctaaacgcctat

SEQ ID NO: 63742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcatggtggttttgtaacggctactcat

SEQ ID NO: 63743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcatttggggtcactgtcctgctcgaac

SEQ ID NO: 63744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttccaatgtcggagttccaatcgcgtgta

SEQ ID NO: 63745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttccaggggtgttcgatcgtgtcgagggc

SEQ ID NO: 63746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttccctaatcgtcctgtcacccggctctt

SEQ ID NO: 63747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttccgcatacctacacaatagtctacacg

SEQ ID NO: 63748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcctcgccaacgtatattagctcgttga

SEQ ID NO: 63749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcctctaccatactacgacttcctgggt

SEQ ID NO: 63750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcctttgcaatttttcatcgtgcgccgt

SEQ ID NO: 63751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcggggcgtgatagggtttgtgtggtac

SEQ ID NO: 63752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttcgttatgaccgcttcaaaccggtagat

SEQ ID NO: 63753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttctatccctcctgatgttctacgttcga

SEQ ID NO: 63754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttctgtctagctctacgggggtggcatgt

SEQ ID NO: 63755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgaagacaggggactccttacctaggca

SEQ ID NO: 63756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgaggtgttttatggctctgatactagt

SEQ ID NO: 63757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgagtgtatccgtacccggcttgctcta

SEQ ID NO: 63758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgcaccaggatagatggtgcgggtaagg

SEQ ID NO: 63759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgcagtcttaacgtcgaattgcacccca

SEQ ID NO: 63760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgcagtctttcccgcggtcaaagccaag

SEQ ID NO: 63761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgcagtttgtgtgctcctttcattgaag

SEQ ID NO: 63762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgcctaagtttgaagtcacgctatatta

SEQ ID NO: 63763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgcctatcattaataattggccaccgtc

SEQ ID NO: 63764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgccttctaatctttggcgagctattag

SEQ ID NO: 63765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgcgagatgacaggcagtcggctgtact

SEQ ID NO: 63766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgctcgacctctcgtggttgcgttcttg

SEQ ID NO: 63767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgctcgtggatgggtgtctcatggtgct

SEQ ID NO: 63768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgggatctatgttggtaggggtagtccg

SEQ ID NO: 63769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgtacgctttgtggtctattgttattcg

SEQ ID NO: 63770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgtacttcgccatctccattcggacgtg

SEQ ID NO: 63771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgtatagtggggcctttacagtgtgacc

SEQ ID NO: 63772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgtgcggtagaaattcgacagatcaggg

SEQ ID NO: 63773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttgtggtgttcagtgtaacccgggcttta

SEQ ID NO: 63774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttacacgtggtaacgacggagacttcct

SEQ ID NO: 63775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttagagggcagaatcatcggggagcatg

SEQ ID NO: 63776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttaggtgcagtgagcgtgctgattgtgg

SEQ ID NO: 63777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttcacgttttgaccttaaatcaggcaat

SEQ ID NO: 63778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttcactccaagctagattgcaagtaagg

SEQ ID NO: 63779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttcgcgctctggaagtgattttgtcggt

SEQ ID NO: 63780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttcggcctcgtggttgacgacatatgcc

SEQ ID NO: 63781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttctccttgaatcgcacgtagttccgcg

SEQ ID NO: 63782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttctttcacgcagtaactcattggtggg

SEQ ID NO: 63783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttgcacgtcgacttatttcttgcgagat

SEQ ID NO: 63784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttgcccccaggtgtatgattagacttgg

SEQ ID NO: 63785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttgccgttagtagaacgccacttgtctg

SEQ ID NO: 63786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttgcgggctacaggcgtatgtacacgca

SEQ ID NO: 63787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttggcaagccgcgagactgacattttgc

SEQ ID NO: 63788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttgtagcccaacgtcgctgcggtccctg

SEQ ID NO: 63789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttgtggcacgatgtttaggcgttcccgt

SEQ ID NO: 63790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcctttgttaaactccctaagtgtgatttatc

SEQ ID NO: 63791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttttagctcgccacggccggtgtccaggt

SEQ ID NO: 63792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tccttttattgaagtctcaccgtgcgcaggct

SEQ ID NO: 63793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaaaggtagagacacggaaggtggtatgg

SEQ ID NO: 63794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaaatgtgagggggcttttagactggttc

SEQ ID NO: 63795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaacacacggtcaggcgttcaccggtggt

SEQ ID NO: 63796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaacacgggggatgatgctatgattgtcg

SEQ ID NO: 63797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaacagagatcgttataggcttactgtgt

SEQ ID NO: 63798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaacccgttatttgatcgctgcgtcacaa

SEQ ID NO: 63799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaaccggaatgctgtgttaagtggtcttg

SEQ ID NO: 63800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaacgctgtgaggggacgctaaatgtgcg

SEQ ID NO: 63801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaactacagtactcagcgggtaattcgtt

SEQ ID NO: 63802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaactcgttaggacaatcatccgcctcgt

SEQ ID NO: 63803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaagcattttccgggcatagggcataatt

SEQ ID NO: 63804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaagggacgtgggcaggtgtgatgcggcg

SEQ ID NO: 63805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaaggtagaaagccccgacgccttattca

SEQ ID NO: 63806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaagttgagtctgtttggggtaggagtga

SEQ ID NO: 63807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaagttgtttccggttatttgggttgagg

SEQ ID NO: 63808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaatacttcgatccattgatttttaccct

SEQ ID NO: 63809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaatattatggctggggggtaggaagagt

SEQ ID NO: 63810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacacgatccaaattgactattgcatggc

SEQ ID NO: 63811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacaggtacggagtggtgatcctatgcgg

SEQ ID NO: 63812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacagtgggcgtcgggcgggtgctcgtcc

SEQ ID NO: 63813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacagtgtgtagttgcatgttggttgtca

SEQ ID NO: 63814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacagtttatggtgctgaatcggtgtgtt

SEQ ID NO: 63815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacatggaaagccttggcatatccggccg

SEQ ID NO: 63816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacattatctccgtggacgctttcatact

SEQ ID NO: 63817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaccgactgcgttcagatgagcgtcgcca

SEQ ID NO: 63818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaccggcgagggtgtaatgttatgaagcg

SEQ ID NO: 63819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaccgttctatccatgcactacggatggg

SEQ ID NO: 63820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacgacacggctagactcatggtttcttt

SEQ ID NO: 63821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacgatcatctcttcccttattcctcccc

SEQ ID NO: 63822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacgcaaccaagacgttcatgggtgggcg

SEQ ID NO: 63823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacgcctacacacgaaagcttgccttgcg

SEQ ID NO: 63824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacgcgacgagggattcgcgtcaccatcg

SEQ ID NO: 63825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacgctaatgccgtttgctgcatcctcgc

SEQ ID NO: 63826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacggatccggatcgattcaagtttattg

SEQ ID NO: 63827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacggattgcggaagaaaatacctagagc

SEQ ID NO: 63828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacggcaggagtctttcatgatcggagct

SEQ ID NO: 63829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacggcgtactctggttttcggccgggga

SEQ ID NO: 63830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacggctgtgatccggccgtggagcaccg

SEQ ID NO: 63831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacggtgcaataaacctagcttctcccac

SEQ ID NO: 63832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaacggttaggtcgcctacgcatgattggg

SEQ ID NO: 63833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaactcgtgcgcggctatggtttgtgtggt

SEQ ID NO: 63834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaactgcgttgcctttgttcggatgtgttt

SEQ ID NO: 63835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaactgggggttaacacttcgtaccaaaag

SEQ ID NO: 63836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagaagacattgaggactcttgtgttccg

SEQ ID NO: 63837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagaagtaactggcggggtcgtttctcga

SEQ ID NO: 63838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagaattgtcagcacaggtaatttggaaa

SEQ ID NO: 63839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagactaacggtagcacaactgagtcctc

SEQ ID NO: 63840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagagctgccactacaagggctgtacacg

SEQ ID NO: 63841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagagtaatccccgttggccagcattgga

SEQ ID NO: 63842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagcaagggtcacagcatgcgcgtgggac

SEQ ID NO: 63843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagcagaagcgctgcaacctgacgggagg

SEQ ID NO: 63844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagcccaaaagttgcattggtcaagaggg

SEQ ID NO: 63845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagccctaacgtcgatccgttactgcacg

SEQ ID NO: 63846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagcgatcaacacctcacaatgcctagtc

SEQ ID NO: 63847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagcggtgtgtgatggatactagcgtggc

SEQ ID NO: 63848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagcttgcgcatatatttcagcttcccca

SEQ ID NO: 63849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaggatgatgtcaggtaaccgttgagcgg

SEQ ID NO: 63850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagggggactgaagacaccgtcctgcact

SEQ ID NO: 63851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaggtctgaagttgcatccgaaccgggag

SEQ ID NO: 63852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaaggttcgctcaacggggtaaacatttcg

SEQ ID NO: 63853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagtctaataagcctcagtagcccgacat

SEQ ID NO: 63854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagtcttctgtgtttggactagtcctatt

SEQ ID NO: 63855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagtgaatgcgcatatttacacggaacat

SEQ ID NO: 63856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagtgaggtgtggtataccccgtggatgc

SEQ ID NO: 63857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagtgtcgtccccgcattagtgccaaagc

SEQ ID NO: 63858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagttattatccgttcttgacacattaga

SEQ ID NO: 63859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagttcttcggtttcatgtagtcactgtg

SEQ ID NO: 63860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaagtttacagcagagaacgaattgtgcgg

SEQ ID NO: 63861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaataatttgcgccatgtcgtgacactcca

SEQ ID NO: 63862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaataccctatggatcgggagagccgcgct

SEQ ID NO: 63863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaatacgttaggcgtggttggtacgttcgt

SEQ ID NO: 63864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaatagcgcgtctttcgaactccgtgtttc

SEQ ID NO: 63865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaatagggtgtatccacacttggtgcctgc

SEQ ID NO: 63866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaatcagcctaccccgaatacgcactccgg

SEQ ID NO: 63867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaatgataggcgattgctgtaatatcatga

SEQ ID NO: 63868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaatgatcttctcgtgctctgttttctgcg

SEQ ID NO: 63869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaatggtgcattttggggtattctgcttat

SEQ ID NO: 63870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaattcagccgagttgtgtctcttgtccgg

SEQ ID NO: 63871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaattgagctgttcctccggacgtgcaact

SEQ ID NO: 63872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaattgggataacgccaggattttcgtacc

SEQ ID NO: 63873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaatttggtcggaacgtaggcaagtttatg

SEQ ID NO: 63874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaaacatttcactccatgatccagatgc

SEQ ID NO: 63875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaacagcgtgcgtaagaaagaggcacac

SEQ ID NO: 63876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaaccagcgtccattgatttgtggcctg

SEQ ID NO: 63877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaaccgtcggtttatgatggatacgagc

SEQ ID NO: 63878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaagagatcgtttgggagcgggtaatgt

SEQ ID NO: 63879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaatcggaaccattcgtcgcgtgctagt

SEQ ID NO: 63880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaattgctttgttccacgtttgagccat

SEQ ID NO: 63881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacacacacgcttccaggttaggtggcggc

SEQ ID NO: 63882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacacaggcctagcccctggcaggcacggg

SEQ ID NO: 63883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaccgttctcctccctccagggccttgt

SEQ ID NO: 63884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacacgccaggccggttcatggaaattcta

SEQ ID NO: 63885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacacgctgtatagacgaattatgcgttcc

SEQ ID NO: 63886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacacggggctgcgggagtcacctggatgt

SEQ ID NO: 63887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacactgctaaccccgtgggcatctgagtg

SEQ ID NO: 63888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacacttcatgcggggctttctattacccc

SEQ ID NO: 63889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacagcacggttggccaaacttcggaccat

SEQ ID NO: 63890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacagccgcgagagccactggtcccgcagg

SEQ ID NO: 63891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaggctcatcgcaatgtgttcgtctgcg

SEQ ID NO: 63892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacaggtttgctggcgagtaatgcagctac

SEQ ID NO: 63893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacagtaccgaagacgaggagccttggacc

SEQ ID NO: 63894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacatagacctaggtcattaagggccgctc

SEQ ID NO: 63895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacatcctttacatgggccttcccctgatc

SEQ ID NO: 63896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacatgacagggccctgctcttgggcgcgg

SEQ ID NO: 63897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacattctccggagtgtgtacatgtgctct

SEQ ID NO: 63898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacatttcatcgttaatctcatgttcccgt

SEQ ID NO: 63899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccaaaggccagtttgctaatcttctgca

SEQ ID NO: 63900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccaagacgtgaccgggactcgcttcgat

SEQ ID NO: 63901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccaagaggactggttatgtcacttcggc

SEQ ID NO: 63902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccaatattccctgcatacttccgttcta

SEQ ID NO: 63903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccagacagttacgatcccacgtgagttc

SEQ ID NO: 63904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccagtaggaggggtttagtcagcaccgc

SEQ ID NO: 63905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccatgacacgctcggaaatgagcgcagg

SEQ ID NO: 63906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccattttgcgtgattacaacccgttctc

SEQ ID NO: 63907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacccgggaaatgtaggtgcggtactcatt

SEQ ID NO: 63908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccgctaatcagcacctgagtttcccttg

SEQ ID NO: 63909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccgctgaaccaatgcgcttgtttccgat

SEQ ID NO: 63910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccggcatggtgctctgcgttgtgttggc

SEQ ID NO: 63911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccgtgacattgatggattgtaaaggtgc

SEQ ID NO: 63912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccgtgtctgcaatccgtaactctcacgt

SEQ ID NO: 63913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacctatgtcagcacatgtttatcacggtg

SEQ ID NO: 63914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacctctgcagcttgagttgcggtaataac

SEQ ID NO: 63915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacctgccattcatctccctatgatgtgct

SEQ ID NO: 63916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaccttacgtcacaccgttaagcgccaatg

SEQ ID NO: 63917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgaaagggtctatcacgtaattttcagc

SEQ ID NO: 63918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgaaccaatgcgagataagcctgatgcg

SEQ ID NO: 63919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgaacctgttcctgttaacaacggtcga

SEQ ID NO: 63920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgcagaccaaaccctaactggatagtgt

SEQ ID NO: 63921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgcaggctgagtattgatgctgatacta

SEQ ID NO: 63922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgcatagcaataatgtggagctcgtatg

SEQ ID NO: 63923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgcatgcccatctcaaatacatcgtgtt

SEQ ID NO: 63924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgccaaagaaagcgtgcacggggtgcgg

SEQ ID NO: 63925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgcccaaaactcgctctccgaacggact

SEQ ID NO: 63926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgcccattgattcagcgatgtcgtcctt

SEQ ID NO: 63927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgccggcagactattcaaactatactgc

SEQ ID NO: 63928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgcgagcaaatgttggggtaatacgttg

SEQ ID NO: 63929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgcgtgaacttgattgaagcaaactact

SEQ ID NO: 63930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgcgtgcacattggacatgtacgaagtt

SEQ ID NO: 63931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgctaacgacaattcaggtggccgggaa

SEQ ID NO: 63932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgctccctcccttcagcccgtcccggtt

SEQ ID NO: 63933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgctctccagtctgattaaaaactccgc

SEQ ID NO: 63934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgctgacactatatcggtttcgcggaag

SEQ ID NO: 63935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgctgtcagccgcgaatactcaacaggc

SEQ ID NO: 63936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacggagttttcgagtggtgcgggataggg

SEQ ID NO: 63937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacggatagcgtgtgggcaatcaattttcg

SEQ ID NO: 63938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacggatatcctctgtgtgccacacggctg

SEQ ID NO: 63939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacggcagcgtgtcggcagtggctcttggc

SEQ ID NO: 63940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacggctatggtacgctggtaagattaccc

SEQ ID NO: 63941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgggaccaacattgacccttgagtgggg

SEQ ID NO: 63942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgggatccaagacattgaccctttttga

SEQ ID NO: 63943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgggatgtgagcattacaggaggcgctc

SEQ ID NO: 63944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacggggatcgacggaaggtccggtatgtc

SEQ ID NO: 63945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacggttagccgattcggacgccacctttt

SEQ ID NO: 63946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgtaggtgctcaaactttctgtgggcat

SEQ ID NO: 63947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgtatcaagacgctgtgttagtgcctca

SEQ ID NO: 63948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgtatgggagcgcactgtttgacttgat

SEQ ID NO: 63949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgtcggacatgtaaggaggtaggccggc

SEQ ID NO: 63950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgtgctctgctcaattggccgggcacac

SEQ ID NO: 63951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgtgctttacactgcctgggtcgtacaa

SEQ ID NO: 63952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgttagcccgggttcttaattagttttg

SEQ ID NO: 63953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacgtttgcaagattagacataagtacggt

SEQ ID NO: 63954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactacgttcgtgacgcttctgccttcatc

SEQ ID NO: 63955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactacttatctgccttatcgagccatatc

SEQ ID NO: 63956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactagccccctgagtgctggagcgatggt

SEQ ID NO: 63957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactagggcattattcaacttgctacgggt

SEQ ID NO: 63958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactcatcgcgcctcttgggactgccggga

SEQ ID NO: 63959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactccactaatactgaggaggagttttga

SEQ ID NO: 63960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactccatcggccgctttgctgtcagttag

SEQ ID NO: 63961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactcccacgtgctgcgatctttatcttgc

SEQ ID NO: 63962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactccgagccttggccagtggacgcaacc

SEQ ID NO: 63963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactcgtggaacaggtaagcaaaccgtgag

SEQ ID NO: 63964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactctcggcgacaatagcgtgtaacctca

SEQ ID NO: 63965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactgaacgtgtccatgatcgttgtacggg

SEQ ID NO: 63966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactgacaggcatgctatccgtgcagtttt

SEQ ID NO: 63967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactgacgtggtaccgagcctgactccttg

SEQ ID NO: 63968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactgacttgcggtcctaacgtaaacggct

SEQ ID NO: 63969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactgatgatcgatagagacagttatactc

SEQ ID NO: 63970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactgcacccgcctatgatctgtttgtcat

SEQ ID NO: 63971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactgcggagggtcataggttcgatgggcg

SEQ ID NO: 63972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactgggtccaagtgctcagcgttatctgt

SEQ ID NO: 63973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacttcattcggtattccggacaggcttac

SEQ ID NO: 63974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgacttcgggacaccctaaggttgctaggcc

SEQ ID NO: 63975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgactttcagtggccacatcgcacctctgcg

SEQ ID NO: 63976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagaaacggccagttggcacaaaacccttg

SEQ ID NO: 63977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagaatcgcagtgaagtggatcaaacttcg

SEQ ID NO: 63978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagacatgccatagccccgagtaggacgac

SEQ ID NO: 63979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagacggtaagaggggtgggcgcagccgga

SEQ ID NO: 63980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagacgtatttgttgcggacttgtagttct

SEQ ID NO: 63981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagagataataaataaggtattagttgaac

SEQ ID NO: 63982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagaggcaaaatcgtcatggtgtagtgggg

SEQ ID NO: 63983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagaggcgtgagtagtcgtatattgtgccg

SEQ ID NO: 63984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagagggtacagcgcgtgcacctcgttgtg

SEQ ID NO: 63985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagatagccaccgcggtcccatcggaggac

SEQ ID NO: 63986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagatagtcgcagatagtgaggtggcaagc

SEQ ID NO: 63987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagatcatgacttggccacatctcacgcgt

SEQ ID NO: 63988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagatcgaagcagacgtgtcgttttggccg

SEQ ID NO: 63989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagatggataatgcactgcatgagcgtctg

SEQ ID NO: 63990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagatggttcaggcggcttattggtcaggt

SEQ ID NO: 63991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagattgtcagcccacctcttggacattta

SEQ ID NO: 63992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagatttctgggaatacttctaaggcgttg

SEQ ID NO: 63993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcaacagccctgtcgcccaacacgtctc

SEQ ID NO: 63994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcacgggtactgtgtcggtgggtcaggg

SEQ ID NO: 63995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcagaaacgtctaagccagatatcgctg

SEQ ID NO: 63996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcagcgtaatacgtctttctcgcctcgg

SEQ ID NO: 63997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcaggcccttctttcgcacccccttgag

SEQ ID NO: 63998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcatgtcatgcttcgttattgccctcgg

SEQ ID NO: 63999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcatgtgcaacgcgccggatagttgcct

SEQ ID NO: 64000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcattaatattgttaccttgggcctttt

SEQ ID NO: 64001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcattcctctccaatttgctagttacgg

SEQ ID NO: 64002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagccaaccgagaggacttcccgcgttctg

SEQ ID NO: 64003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagccaatctgccggacatctctgcactgc

SEQ ID NO: 64004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagccatacaaacaaacgccctggtccggg

SEQ ID NO: 64005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagccgctgacagtgagctttattgtgcct

SEQ ID NO: 64006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagccgggcacacgcgacattttcacggtt

SEQ ID NO: 64007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagccttgggccgttccccgaactaatacg

SEQ ID NO: 64008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcgaatacgactcactataggggccagc

SEQ ID NO: 64009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcgaggcgacggtagatccgctcgttta

SEQ ID NO: 64010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcgccgtcactgactgtttgccagcttg

SEQ ID NO: 64011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcgcgacaattcccctcactggatgtca

SEQ ID NO: 64012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcgctcaaaactcacaacgtcaggtttg

SEQ ID NO: 64013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcggcaaccgaccatactccttctgcgg

SEQ ID NO: 64014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcggcaataggcttttaagttatcgtac

SEQ ID NO: 64015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcggctgttggcacgtccggtaccccat

SEQ ID NO: 64016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcggtcattcgagtcgtcccctctcctg

SEQ ID NO: 64017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcgtgccgagtccgccggagaaagtgta

SEQ ID NO: 64018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcgttagattcacgttaataagttgtta

SEQ ID NO: 64019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagctaggccccatggcattttgctgcgtg

SEQ ID NO: 64020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagctcatcctgaatcctgtgtcgtagcta

SEQ ID NO: 64021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagctcgtccggtcgcagcacagcctggaa

SEQ ID NO: 64022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagctcgtgtggcttcatctggggagtccg

SEQ ID NO: 64023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagctctgttgacgccgctaaaaacccgcg

SEQ ID NO: 64024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagctgacactttcctattggcttttcttt

SEQ ID NO: 64025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagctgctgaaaaggtccggtcctttgagt

SEQ ID NO: 64026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagcttccatcgtgacacactagacgtagt

SEQ ID NO: 64027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggaacgcccttccatcgctgtgcgtagg

SEQ ID NO: 64028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggaactggtcgtttgcctgcatttatga

SEQ ID NO: 64029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggacgcgtggtaggcccagccagcggtg

SEQ ID NO: 64030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggaggcgcacgggtttgaggcagtcgtc

SEQ ID NO: 64031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggatcgacgcgaggggaatggtcttcca

SEQ ID NO: 64032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggatcgcctgtataacgatcgcccttga

SEQ ID NO: 64033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggatgctatgcaggcgtaataaccgcgg

SEQ ID NO: 64034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggcaatggatcacaatacacgctcgctg

SEQ ID NO: 64035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggctgcatagcttgggtagccttagtcc

SEQ ID NO: 64036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagggcatgttacaacgtcattcctgccgc

SEQ ID NO: 64037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagggcttgcaggactcggtccgctctcac

SEQ ID NO: 64038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggggcacggcctttcacgacagatcgcc

SEQ ID NO: 64039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggggccacgatggatgtctcgctcaggg

SEQ ID NO: 64040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagggtcgacagtctcggccaactcgccgt

SEQ ID NO: 64041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagggtgttatcttttgtgagtgatgtacg

SEQ ID NO: 64042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggtaaatgacacgcgacggtatggggtg

SEQ ID NO: 64043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggtaaccagcaccggtggcccggggaat

SEQ ID NO: 64044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggtccgcattctagttgattgtgccacc

SEQ ID NO: 64045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggtcgaaatggcagcacaggcataagtg

SEQ ID NO: 64046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggtcgcgtgtttggtaaaggctttgagc

SEQ ID NO: 64047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggtgaataaaaggtatagaaaggcttac

SEQ ID NO: 64048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgaggtttttaagcacatttaagtaagcaag

SEQ ID NO: 64049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtagcaagcacggcgacctccatcatcg

SEQ ID NO: 64050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtataatcctatttccccacgggacttt

SEQ ID NO: 64051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtcaaaacgaagtcctaaggcacagggt

SEQ ID NO: 64052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtcacgataaggtgaggtcccgacgacg

SEQ ID NO: 64053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtcatcccgttcttcccaactaaaggga

SEQ ID NO: 64054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtccggcttggattacgtggtttctgcg

SEQ ID NO: 64055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtccttagctgctcaacacgaacgctgt

SEQ ID NO: 64056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtgaattgcagcagacgcgtttgattat

SEQ ID NO: 64057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtgcgggtaaggttcgcaaatgaagttg

SEQ ID NO: 64058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtgggtcatagctgtgttcgatggccgt

SEQ ID NO: 64059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagtgttcgggaatgcacggcttggctggg

SEQ ID NO: 64060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagttcaggttgttccctgatccggccaag

SEQ ID NO: 64061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagttcttagatgctgtaggttcgttatac

SEQ ID NO: 64062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagttgaactgcaagccgggcccctgacgc

SEQ ID NO: 64063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagttggcgcaattttgccgtagttccggt

SEQ ID NO: 64064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgagttgggtaacccgttggaagcagcctgt

SEQ ID NO: 64065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgataaattcatttaaagcaggcgctaatgg

SEQ ID NO: 64066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgataactgacgctttctaggatgagcacgc

SEQ ID NO: 64067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgataacttaagcacgaccattttgaccggg

SEQ ID NO: 64068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatacaaactaattcgttacggtagggtat

SEQ ID NO: 64069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgataccctcggccttaggatgctcgtcgtt

SEQ ID NO: 64070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatacgatctgtattatgatatgaaacagt

SEQ ID NO: 64071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatacggcagtctccctccacacaacgata

SEQ ID NO: 64072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatacggtaacacttacggttttcggaccg

SEQ ID NO: 64073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatagacttcgcaacgtgtttccgtccaat

SEQ ID NO: 64074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatagccgtcgaaagatccggggcttcctg

SEQ ID NO: 64075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatagcctagccaatttcccccgcccggac

SEQ ID NO: 64076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatagcgctaaagagtgtaggtgcgctcgc

SEQ ID NO: 64077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgataggaatcagcgccttcctagtgcaatc

SEQ ID NO: 64078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgataggagctaagcgtccgtctctccggtt

SEQ ID NO: 64079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatatgaggttcgatacaaagccgactttc

SEQ ID NO: 64080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatatggcaggccgggaccacaagcgttgc

SEQ ID NO: 64081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatatgtccgatagaggtgcttgggtgacg

SEQ ID NO: 64082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatcaggtttcgaaacggggggtataccgg

SEQ ID NO: 64083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatcagtgcgcttctcacaatactagctaa

SEQ ID NO: 64084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatccacatcggaaaacactgttcccttcg

SEQ ID NO: 64085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatccgcagcacgtgcgatgctggcgccta

SEQ ID NO: 64086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatcctgacatctcagagttttctcatcat

SEQ ID NO: 64087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatcgatgctccgtttggtgagatttcata

SEQ ID NO: 64088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatcgcagaagcttttagaatgtacccggc

SEQ ID NO: 64089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatcgggaaatacactaacttggaagtagg

SEQ ID NO: 64090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatcgtttgagcgagtcagacttctagttg

SEQ ID NO: 64091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatctacgtaatcactcgtgcatcctcaac

SEQ ID NO: 64092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatctatggaatggatctacttttgtaatg

SEQ ID NO: 64093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatctcattggcctgcccgacggagactac

SEQ ID NO: 64094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatctgccgcacgtccgatttgccattagg

SEQ ID NO: 64095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatctgccgtctcttctgattgcgttaccg

SEQ ID NO: 64096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatctgcgcggacggagaggtgtgggtcat

SEQ ID NO: 64097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgaagaggcggtgctacatcttactgaa

SEQ ID NO: 64098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgacccacttatgatacgatcacggcgt

SEQ ID NO: 64099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgaccgtataggtttctgccggtatctt

SEQ ID NO: 64100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgaggagatgtgctgggctaccgttgtg

SEQ ID NO: 64101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgatcggtcgttccgcgttctgtgtccg

SEQ ID NO: 64102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgcacggtcgcaggtaggggtttgcgat

SEQ ID NO: 64103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgcataggttactggataagcgcggtgc

SEQ ID NO: 64104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgcatgctcgagagcttagtaacctatc

SEQ ID NO: 64105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgccgaccaagccaccatatttcgtcgg

SEQ ID NO: 64106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgcttgacaggccggtcaactgttgtct

SEQ ID NO: 64107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggaagcgcgcagatgatcggtacggcc

SEQ ID NO: 64108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggacatccaccctaagagccctttttt

SEQ ID NO: 64109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggacgggtgggttcagagtggacattg

SEQ ID NO: 64110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggatcgagtgactagtacaagcttggg

SEQ ID NO: 64111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggatctccgcaatcgataggagcgcgt

SEQ ID NO: 64112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggatgattgtagtagcctccgaacgtt

SEQ ID NO: 64113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggcttattggccgttgggtgctatgtc

SEQ ID NO: 64114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgggcgcctgacgacaagccggcaagtc

SEQ ID NO: 64115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggggacagagcggcttgttatccgacc

SEQ ID NO: 64116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatggtagccccaaatagaactcgtcctgc

SEQ ID NO: 64117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgtacttagtgtggaattcggtagcgtt

SEQ ID NO: 64118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgtataagggcaggacggcagagaacgc

SEQ ID NO: 64119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgtcacctcgtacggcacgggtcaggtt

SEQ ID NO: 64120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgtcttgactccttgtaagggcaggacg

SEQ ID NO: 64121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgtgggcctgtccagggtgatgattggg

SEQ ID NO: 64122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgtggggtggtgagaggccagcgtgttg

SEQ ID NO: 64123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgtgtggacctaccgcagggctgcgcac

SEQ ID NO: 64124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatgtttggctccctcgccttttggttggc

SEQ ID NO: 64125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattaatgcctgtagctctagggcggctct

SEQ ID NO: 64126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattacgttcgggattacggtcgtgttctt

SEQ ID NO: 64127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattactgtgaattaaggggtctggtagag

SEQ ID NO: 64128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattagaccaactcgcccgttgtgaccgcc

SEQ ID NO: 64129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattagagtacactgatgaatggctgcgcc

SEQ ID NO: 64130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattagcacttctgggtttagagtgctcgt

SEQ ID NO: 64131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattagcgtcccccgactgcgtggtgtgcc

SEQ ID NO: 64132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattatccgtacttggaggtgccgctggtt

SEQ ID NO: 64133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattcccgggcttaacgtgtggtacagggt

SEQ ID NO: 64134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattctcctgttacacgttctcggcgttgg

SEQ ID NO: 64135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattggagcgtgaatggtggatcggcgggg

SEQ ID NO: 64136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattgggaattttgagacccctgttgagtg

SEQ ID NO: 64137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattgggtgtcacacttggcaagggtgttg

SEQ ID NO: 64138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatttcacacctagtgagcctaaactgagg

SEQ ID NO: 64139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgatttgacaaggagtatgttcacatacacc

SEQ ID NO: 64140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattttaattttatccggtctcgaagtaag

SEQ ID NO: 64141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgattttgtccgattgcatgaaggctctttc

SEQ ID NO: 64142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaaaaacttaagccagcgtatcggttatt

SEQ ID NO: 64143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaacaccgagcacggaatcctcatcgcgg

SEQ ID NO: 64144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaacaggagcgtcaaccccttcaccggac

SEQ ID NO: 64145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaaccaaccgctttactatccggtggtta

SEQ ID NO: 64146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaacgcggggtagagcctctaatggagta

SEQ ID NO: 64147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaacgctcggccgtgcccctctgggattg

SEQ ID NO: 64148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaacggacagcgcggggctactaacgagc

SEQ ID NO: 64149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaacggcaggatagcgtgagctgggttac

SEQ ID NO: 64150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaacggtctcttcggccaaattgtgtcgt

SEQ ID NO: 64151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaacgtagccgcaaagtttcgattttggg

SEQ ID NO: 64152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaacgtgtctgtgtctcttctggggtgtg

SEQ ID NO: 64153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaagccgctgctagccagataaagccgga

SEQ ID NO: 64154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaagccgtctcgatgtagattgccggtat

SEQ ID NO: 64155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaataagggggccgatgtgcaaataaaat

SEQ ID NO: 64156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaatggaactttcgtcgcgaccaagatct

SEQ ID NO: 64157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaatggtgtccgggtttctgtcgaaggcg

SEQ ID NO: 64158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaattaaatgagcagggtcttgcaatagc

SEQ ID NO: 64159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacaaggaaggtgagaaccgtcacgcgac

SEQ ID NO: 64160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacaatgtccagaccgattgacagcgtgg

SEQ ID NO: 64161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacacacgccgcttaagcagcaagagtcc

SEQ ID NO: 64162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacacgagcgtgcactggtcaggctcttt

SEQ ID NO: 64163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacagagaatgcacgacggagatcggata

SEQ ID NO: 64164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacaggctgctctccttcgccatgggacg

SEQ ID NO: 64165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacagttgcgactacgaacaaagggcgcg

SEQ ID NO: 64166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacatgggacgggatgtcctccgatgcta

SEQ ID NO: 64167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaccaaggcgcggggtatggaggagttgt

SEQ ID NO: 64168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaccactgaagggagacaatatcgaaacc

SEQ ID NO: 64169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacccacaacgcgaacggcattttcgttt

SEQ ID NO: 64170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaccccaggtttacgcattgctcttcgtc

SEQ ID NO: 64171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaccctaggccgttggatggttttatctt

SEQ ID NO: 64172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaccgacgcagccgcaccgtgtgggagga

SEQ ID NO: 64173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaccgactcgtggcccctggttaccggcg

SEQ ID NO: 64174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaccgggacaatatgcggtatccgcacgc

SEQ ID NO: 64175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaccgggctacatcttcctgttcacattt

SEQ ID NO: 64176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaccgttttggccgaggatggtttttggg

SEQ ID NO: 64177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacctataggccgacacgatgggtgcgtt

SEQ ID NO: 64178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacctttattggtgactgcgtacaggatc

SEQ ID NO: 64179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacgcccggcctcaccgagggtctcatac

SEQ ID NO: 64180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacgcgtattgccaagaagtttgtgtagc

SEQ ID NO: 64181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacgtaagtcaaggaacgcccctcagttt

SEQ ID NO: 64182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacgtagtcgagtacagaaagtgaggggg

SEQ ID NO: 64183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcactatgagacacgttaacgtcgtttctt

SEQ ID NO: 64184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcactcgcagatctatcgatttctgctctt

SEQ ID NO: 64185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcactggcaaatccaccgggtgactcagca

SEQ ID NO: 64186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacttagcacaggctgcgtccatcggttg

SEQ ID NO: 64187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacttcacactgtctcggttcctctctcg

SEQ ID NO: 64188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcacttcggctacttaccggcaagaggggt

SEQ ID NO: 64189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagagcaacttcgctgaggggccgaacgc

SEQ ID NO: 64190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagagggcccagcgttaatgatccatgct

SEQ ID NO: 64191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagaggtataacagctaaggtacgggtag

SEQ ID NO: 64192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagagtattctatttcatcctgatgagtt

SEQ ID NO: 64193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagcaaaaggttcggtcacttcttccacg

SEQ ID NO: 64194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagcccgacgttaggacgacgttcaacac

SEQ ID NO: 64195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagccggacgcggtgctggaccgtatcta

SEQ ID NO: 64196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagcttgcgtgagatgaggacggaatggg

SEQ ID NO: 64197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaggaataacggatttggctataccttgt

SEQ ID NO: 64198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaggagtgctacgttgatcgtccgcatga

SEQ ID NO: 64199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaggatggccgagagggtggatgtgcgtg

SEQ ID NO: 64200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaggattcggatcttgggagaccgcatcg

SEQ ID NO: 64201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagggcttggaaaggtcgcgtggcctctg

SEQ ID NO: 64202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaggggtgctagggcaaagcttctagcgc

SEQ ID NO: 64203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagggttctaggggacctggcgggtgggg

SEQ ID NO: 64204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagggttgaaatggttacttaacgcagga

SEQ ID NO: 64205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcaggtatgggatgtcgagtggtgcaacgt

SEQ ID NO: 64206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagtacgtacagaggtggtcgtaaagggg

SEQ ID NO: 64207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagtaggaacgtcactgcaagccgagtgc

SEQ ID NO: 64208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagtggcttggtggtgaagcgttaatctt

SEQ ID NO: 64209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagttaggatgccgagccacgttactatg

SEQ ID NO: 64210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagttataatccacaagttcacccggcgc

SEQ ID NO: 64211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcagttcgaatttacgcccctacgccttac

SEQ ID NO: 64212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcataaggtgccaggtgttagacctgggtg

SEQ ID NO: 64213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcataccgaagatacccatgcctccacgat

SEQ ID NO: 64214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatacgttacggaatagcctcggcagagt

SEQ ID NO: 64215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatcaccgatggtttcccgattgcgttgg

SEQ ID NO: 64216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatcagtggtttggaccgggacatcgcca

SEQ ID NO: 64217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatcccgcataattcctttaggtatggtg

SEQ ID NO: 64218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatccggtgtttctttcacgcgatctctg

SEQ ID NO: 64219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatgatgcgtggtactaactccgggcgga

SEQ ID NO: 64220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatgatggaaataatgttttgtggatgca

SEQ ID NO: 64221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatgcaggggcttccgggtaagtatgatt

SEQ ID NO: 64222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatgctcgaacgaatcttcataaattgtg

SEQ ID NO: 64223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatggtacgtttggtgtgaccttttcact

SEQ ID NO: 64224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatgtaagcgtgactgcacctgttgtacc

SEQ ID NO: 64225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatgttgttccatttgtcgccctcatcac

SEQ ID NO: 64226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatgtttactacattatggggaagaatag

SEQ ID NO: 64227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcattagtggacatttgatactgctgttgg

SEQ ID NO: 64228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcattcacggtggcgtcccattttcttctc

SEQ ID NO: 64229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcattctaccgcaggttgctcgcgagcaac

SEQ ID NO: 64230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcattctaggggtccaattacagctcaagt

SEQ ID NO: 64231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatttaggccattggtgtttgcacgactt

SEQ ID NO: 64232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcatttggagtacacgctggcagtatcgat

SEQ ID NO: 64233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcattttagtttgtggcatggtcttaggtt

SEQ ID NO: 64234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccaaccgccttaacgtgtctaacatgcga

SEQ ID NO: 64235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccaaggtcgagatagttcttccacaattt

SEQ ID NO: 64236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccaatcactattctactcggagctcggca

SEQ ID NO: 64237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccaatcgcggtctgaagcaacgtactcaa

SEQ ID NO: 64238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccaatgtcgaagatactcacgcgtagttt

SEQ ID NO: 64239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccaattttgagtcggtcctgaaatggaag

SEQ ID NO: 64240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccaccagatctgttttacgaggtaaagtc

SEQ ID NO: 64241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccacctcgttgatcggttctcttgaggca

SEQ ID NO: 64242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccacctgaatgcgttgcggactcggttgc

SEQ ID NO: 64243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccacgtgcgatcggctttgcttatgtagg

SEQ ID NO: 64244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccacgttgctatcctttcactcggcgccg

SEQ ID NO: 64245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccactgtcacggtcatgttggggccgctg

SEQ ID NO: 64246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccactgtgctgacttctttcccgcggatt

SEQ ID NO: 64247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccagcaagtgatggcttttcacactaagt

SEQ ID NO: 64248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccagcaggtaccaggtgccgggcgtcagg

SEQ ID NO: 64249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccagcgggggaagctctggtttttcgtgt

SEQ ID NO: 64250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccagctatcgatcactacaactttcgtac

SEQ ID NO: 64251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccaggcggtgggcgtgtccggaacgtgcg

SEQ ID NO: 64252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccaggtggatcgtcacggatactccacat

SEQ ID NO: 64253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccagtaaagtcaacggttacgaacgcaac

SEQ ID NO: 64254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccagtcacaagacatagccctcgcgccgg

SEQ ID NO: 64255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccagtgttgaggcaattcgggtgcttcca

SEQ ID NO: 64256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccagttgggtagttcttctgcgatagtcc

SEQ ID NO: 64257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccatcaaagtgagcacatctcttggtaac

SEQ ID NO: 64258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccatgtgggtattgcagttatctcagcga

SEQ ID NO: 64259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccaaaccaatttcaatccgatgggccgc

SEQ ID NO: 64260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccaaggtggggatgaaattcttccctta

SEQ ID NO: 64261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccactcatagaccctaaactctgaggtc

SEQ ID NO: 64262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccatcgagtgcttagaatatgtgagtcg

SEQ ID NO: 64263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccccaaagcgggatgagtgtcagtgttta

SEQ ID NO: 64264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccccatacgctcactaaattacaccccga

SEQ ID NO: 64265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccccgcccgccttgggaactcgatacga

SEQ ID NO: 64266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccccgtgtgcggcaattggtcccagagt

SEQ ID NO: 64267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccgaaagttagcgtatcgtctccgtggt

SEQ ID NO: 64268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccgaaccaccttgccgcccaccatggct

SEQ ID NO: 64269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccgaagtaaacgagaaggcctagaggct

SEQ ID NO: 64270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccggccggacttgtcgtagcgcgctagg

SEQ ID NO: 64271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcccgttgaacttctccgtaatcaatgcct

SEQ ID NO: 64272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccctaccaagctgcctgtctgggtggagt

SEQ ID NO: 64273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccctcgagattacagccaaaatcgttggg

SEQ ID NO: 64274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccctctatacgactcttgtgaatcgacgt

SEQ ID NO: 64275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccctgagcggttggtcgggcttagcttct

SEQ ID NO: 64276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccctgtgttgccgttggcaccgatagatt

SEQ ID NO: 64277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgagagtgttttatggaagaagtccagc

SEQ ID NO: 64278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgaggtcgagctgttcggtggacacttc

SEQ ID NO: 64279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgagtccggaggcaaactaagcttaacg

SEQ ID NO: 64280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgagtcgcgcaacaaagtgtgacaccac

SEQ ID NO: 64281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgagtgcggtactcaaggtcttgtacgt

SEQ ID NO: 64282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgatgaccggtttagcacatgttgcgtt

SEQ ID NO: 64283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgcgatcgttaacgccaaactaccttcg

SEQ ID NO: 64284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgcgatgaccaatgaccatcagaagcgt

SEQ ID NO: 64285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgcgtaggatttggtcgctcttaatgac

SEQ ID NO: 64286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgcttaaaaacacaacgtttctgggtgt

SEQ ID NO: 64287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccggctagccgtagtccatcagaccgcac

SEQ ID NO: 64288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgggattcactggtgtgtgcataagtct

SEQ ID NO: 64289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgggccacttccggatggtgtatacagc

SEQ ID NO: 64290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgggccatctaccgaaacgcgccctcca

SEQ ID NO: 64291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgggcctccaaatggctggagtgtgggt

SEQ ID NO: 64292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccggtcgccgcaacacatatagactcaac

SEQ ID NO: 64293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccggtgcggggtcgaatgtacgttttcgg

SEQ ID NO: 64294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccggttgttatgtgtgcatttatgtccta

SEQ ID NO: 64295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccggttttacccgggaaggtcgcttgtcc

SEQ ID NO: 64296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgtatggcgtcaacacagtgtcatcacc

SEQ ID NO: 64297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgtgaccgatccgtgcacaactcactct

SEQ ID NO: 64298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgtggtatttaacgtatatgccctttag

SEQ ID NO: 64299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgttaactcgtggctgataacccttacg

SEQ ID NO: 64300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgttcagattcgcgagagtgtccttgga

SEQ ID NO: 64301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccgttgtttgctcgtcttcattttccgat

SEQ ID NO: 64302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctacatggatctccaacgttcgcgtcgg

SEQ ID NO: 64303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctactacggatgccataggtctccgagc

SEQ ID NO: 64304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctcaagtaggatatcgtgcacgggtccg

SEQ ID NO: 64305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctcatggggaggatcgattgtggtttgg

SEQ ID NO: 64306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctccggaacggcatccagaagtggttgt

SEQ ID NO: 64307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctcctggctacgtttagttgatgttgga

SEQ ID NO: 64308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctcgccgctctgactttagcattctcgt

SEQ ID NO: 64309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctctgcgtacacgcgctggctttgccaa

SEQ ID NO: 64310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctcttcgtgtaaggggcttattttaccc

SEQ ID NO: 64311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctgagtcaagctatttttggcggcatca

SEQ ID NO: 64312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctggacttgagtttgatcgggacaggta

SEQ ID NO: 64313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctggcctcgggctccttcttacgactgc

SEQ ID NO: 64314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctggggggcctcgtttgtttccgatgtc

SEQ ID NO: 64315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctgtcgcatcgtttgacgatgaatcggg

SEQ ID NO: 64316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctgtgcctaccccgttatgttaagtttc

SEQ ID NO: 64317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccttaactgtgcttcacggagcggttggg

SEQ ID NO: 64318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccttacccgcaaaggcctcttcgcgagca

SEQ ID NO: 64319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccttagcaacgtcaatttcgatcgctcgg

SEQ ID NO: 64320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccttagcgacggtttggtactgcctgaac

SEQ ID NO: 64321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccttcaaagtcaatgggctgaaataacgc

SEQ ID NO: 64322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccttgtagtggtgtgcatgtgaagttcat

SEQ ID NO: 64323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccttgttaggtggtccatgcaaaccccgg

SEQ ID NO: 64324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcctttgtaatgacaccagacatatgtaac

SEQ ID NO: 64325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgccttttcatcttgcttgacgggtagtcgg

SEQ ID NO: 64326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaaaccacctgcctttatctttgcggta

SEQ ID NO: 64327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaacagcttcttacggcttgcattattg

SEQ ID NO: 64328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaaccatgcccggggtcagctgctcaga

SEQ ID NO: 64329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaaccttcaaacttgcgacgttttagag

SEQ ID NO: 64330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaagaggcaactggcctgagtagtttat

SEQ ID NO: 64331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaaggcaccgttgcaaccttgcggaagt

SEQ ID NO: 64332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaaggccatcaacatgaacctggacccg

SEQ ID NO: 64333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaatgacctggaagtctagagcggtaag

SEQ ID NO: 64334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaattggagggttgaatttgatcgcttg

SEQ ID NO: 64335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaattgtggtgtcactgaatttgttgtg

SEQ ID NO: 64336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaatttgctgagcccttcgataggaacg

SEQ ID NO: 64337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgacaagtccttatcacgtcgacgcccgg

SEQ ID NO: 64338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaccgtctgtcacatcttccatcagagc

SEQ ID NO: 64339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaccgtcttcatggaatgccattccccg

SEQ ID NO: 64340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgacggaccaactgcgagggcctcgtccg

SEQ ID NO: 64341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgacgtcatttacaagttccagcgggtca

SEQ ID NO: 64342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgacgttcccagcattcgcggtgtcatct

SEQ ID NO: 64343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgactagcgttggtctggtctgcgcgtca

SEQ ID NO: 64344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgactcggttgtatcactgggccattctg

SEQ ID NO: 64345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgactctaataggatctgtgtctcgaggc

SEQ ID NO: 64346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgactgaacgggttaactatgcgagtgtg

SEQ ID NO: 64347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgagacactggcgcaaagtacaatcagtt

SEQ ID NO: 64348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgagagttcggatctaaacctgcccaggg

SEQ ID NO: 64349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgagatcacggggatagggttgtgcggct

SEQ ID NO: 64350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgagcagagacgtcaaagacgatcatcgg

SEQ ID NO: 64351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgagcggatactcagctaataacgggatg

SEQ ID NO: 64352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgaggacaacgagactcactcgttgctga

SEQ ID NO: 64353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgagtacttttcgttagcgtctgctgcga

SEQ ID NO: 64354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgagtggcactatagccgcagacaagagt

SEQ ID NO: 64355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgatccgttactctcaatggtgtgctact

SEQ ID NO: 64356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgatcgccgccaatccgggagccagtttc

SEQ ID NO: 64357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgatggacagtatacgtagagctgttcgt

SEQ ID NO: 64358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgatgggataggctctatggctgctcaat

SEQ ID NO: 64359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcaatcaccgacatccatatctcagctc

SEQ ID NO: 64360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcaccgttcacaagtagggatcatacta

SEQ ID NO: 64361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcagtaggcggactgtcggcggattcgg

SEQ ID NO: 64362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcataacgctacagaactcctcctcgga

SEQ ID NO: 64363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcatgatgaaccgttaacgggaagctgg

SEQ ID NO: 64364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcatgggttacttgcaacaccgcctgta

SEQ ID NO: 64365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcatgtcgaagttggcagtgtttcctgg

SEQ ID NO: 64366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcattaactttgctgctccctcgctgga

SEQ ID NO: 64367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgccagcaggttgtatatcacgttttctg

SEQ ID NO: 64368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgccatggctttcaagtgtgctcgtgcca

SEQ ID NO: 64369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcccacgttctgggacctagtccaaacc

SEQ ID NO: 64370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcccatagcacctgggatcatcttgctg

SEQ ID NO: 64371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgccgagttaacgtcatatcgaaggggcg

SEQ ID NO: 64372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgccgcagcctaaagctcatctcgcacgc

SEQ ID NO: 64373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcgagtcagctttatcccactgggggtc

SEQ ID NO: 64374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcgatcagtagttgcagtcaagtagttg

SEQ ID NO: 64375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcgatcgggggacataccattgggccga

SEQ ID NO: 64376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcgcaatatttcgggcccggctcttgag

SEQ ID NO: 64377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcgcgggtagtacggttagcttctttgg

SEQ ID NO: 64378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcggagtggatgcttccggaaagtgatg

SEQ ID NO: 64379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcgggagtggaacgcagacagtctggtt

SEQ ID NO: 64380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcgtaagtagaaagcttgttgcgtgctc

SEQ ID NO: 64381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcgttacgataacgtgattgctttagtt

SEQ ID NO: 64382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgctccaggggtccacccaccggtccgtc

SEQ ID NO: 64383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgctcgggccgtcctttgttgccttagga

SEQ ID NO: 64384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgctctccaaggcgtaaagttcaccatcc

SEQ ID NO: 64385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgctgaaacacgttcgtatcccctgcccg

SEQ ID NO: 64386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgctgcagtaacacctttgttcagttacg

SEQ ID NO: 64387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgctgcttaaaacgtcattaccggcgcca

SEQ ID NO: 64388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgctgtgttggtagaaggtaattggactg

SEQ ID NO: 64389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcttacctcttctgtaggagtacgtaca

SEQ ID NO: 64390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcttacgtcaatttcagcggagcggcgg

SEQ ID NO: 64391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcttggtctccgggtcgtttcttttggt

SEQ ID NO: 64392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgcttgttgtcaaaagacacgcagcgtcc

SEQ ID NO: 64393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggaactggttgctcacccgcccattaat

SEQ ID NO: 64394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggaagtgtgccgacgactaataaaggca

SEQ ID NO: 64395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggaatccaacgtgccaatcagtggctaa

SEQ ID NO: 64396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggagagtgcgttcatgcttgcagagttt

SEQ ID NO: 64397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggagcgggcaactcgaagacgggagtca

SEQ ID NO: 64398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggatcatcgagggtgattattcaatgtc

SEQ ID NO: 64399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggatcgttcagccttgagttcaggtggc

SEQ ID NO: 64400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggattcatgatcgaaccaggtgtttctt

SEQ ID NO: 64401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcacgggggttaagcgcttgatgatga

SEQ ID NO: 64402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcacggtacttcgacttatccgttgtc

SEQ ID NO: 64403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcatacgtcattcttctgtttactttt

SEQ ID NO: 64404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcatcggggctcgaccggctgcgcttc

SEQ ID NO: 64405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggccacactgacacttggagtacactgt

SEQ ID NO: 64406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggccaggtgattcaacgccaccacttgg

SEQ ID NO: 64407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcgacatcgtatagaacgatatgcggg

SEQ ID NO: 64408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcgatcagtgcatcatctactggcttt

SEQ ID NO: 64409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcgcttctccccggcaactgcgcattg

SEQ ID NO: 64410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcggccgacgtatcaacgtggaggctg

SEQ ID NO: 64411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcggctctacaattcatgttcacagtg

SEQ ID NO: 64412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcggggtgtacaaggtcggaccgtacg

SEQ ID NO: 64413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcgtgttgttattaccagacttttacc

SEQ ID NO: 64414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggctcgtctcacgctagaaaattaggca

SEQ ID NO: 64415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggcttccacgttactagcagtcaaaatg

SEQ ID NO: 64416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgggaagaaggggaaatgagggatgcgac

SEQ ID NO: 64417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgggacgggtgtgcgcggggctccgggtt

SEQ ID NO: 64418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgggagaagggcctagccggatggtgacg

SEQ ID NO: 64419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgggagaggactcggtagtatggtagata

SEQ ID NO: 64420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgggagcagttacgggagtgcatatgggg

SEQ ID NO: 64421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgggaggtctaagtcttagtggggtgggt

SEQ ID NO: 64422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgggctaactcgtcacaaacgtggggcgg

SEQ ID NO: 64423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggggaacgggatcttttggcatcacccg

SEQ ID NO: 64424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggggcagtctagggtataaggtttgtgg

SEQ ID NO: 64425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgggggcggtggtgcttatacttaagtca

SEQ ID NO: 64426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggggggattggaattctgtgcactggcg

SEQ ID NO: 64427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggggggcaatcagtgaaccgcactcttc

SEQ ID NO: 64428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgggtcgaaagtaatgcataattcccctt

SEQ ID NO: 64429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgggtcggtgcgtgagtctggtaatcgtg

SEQ ID NO: 64430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggtcactacaaagcggtaatagcttgtc

SEQ ID NO: 64431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggtcctgagctgttccttggatgtatta

SEQ ID NO: 64432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggtgggagtcgattccgctatccagtcg

SEQ ID NO: 64433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggtggggacgagtgggtgcatgtgcgcg

SEQ ID NO: 64434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggtggttggcggctacaaacagccccat

SEQ ID NO: 64435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcggttaggtgtaaatgctcgaggcgcatt

SEQ ID NO: 64436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtacaggtgaagtgatcttgatgtaaac

SEQ ID NO: 64437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtacccgtatatcgtcgctggctgaaat

SEQ ID NO: 64438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtagattgctcgtggggaaggggctcgt

SEQ ID NO: 64439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtcagaaagcttagttgatggacagact

SEQ ID NO: 64440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtcatacgtccaatgcagtcggttcagg

SEQ ID NO: 64441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtcggtgttagtagccaataaggtgttc

SEQ ID NO: 64442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtcgtgattgctggatctgaagcgtgcg

SEQ ID NO: 64443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtgcgttcttatctggcagtagactgtg

SEQ ID NO: 64444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtggctcggttaccggagatatcgtcct

SEQ ID NO: 64445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgttacatccgtaggcgcatagtacttag

SEQ ID NO: 64446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgttccttcatcctcaatggatattcgtt

SEQ ID NO: 64447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgttgccacgtttcttaagctgcggattc

SEQ ID NO: 64448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgttggcacttgaggttagtggttgggtg

SEQ ID NO: 64449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgttgggcgcagttcacgctttccgcccc

SEQ ID NO: 64450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgttgtcggggaagaatatgacgtaaatg

SEQ ID NO: 64451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgttgttaccatgggcccggttggtgcga

SEQ ID NO: 64452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtttaggaggcgttggattacataaggg

SEQ ID NO: 64453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtttgcaaaaatccgtactatgaacgta

SEQ ID NO: 64454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtttgcctgataaattcacgctgacccc

SEQ ID NO: 64455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtttggcagaactcctatcggtacattc

SEQ ID NO: 64456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcgtttgggtggcgcctggataccttggat

SEQ ID NO: 64457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctaaataaactgcacctcgctctgggatt

SEQ ID NO: 64458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctaacgggtctttgttgaatgctttacgc

SEQ ID NO: 64459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctaagctcagctgaaccgcctggggttga

SEQ ID NO: 64460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctaagtacggtcagtggcacttttcccga

SEQ ID NO: 64461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctaatgatctcgttgtcatggctgatcgt

SEQ ID NO: 64462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctacaggcacacggtaaagtcgccgtcga

SEQ ID NO: 64463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctacatatgaccgggcactggcatcttac

SEQ ID NO: 64464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctaccggcagcagagaattctcccggcta

SEQ ID NO: 64465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctactccctatgatatcagtagtttgccg

SEQ ID NO: 64466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctagaacaggttctcaagcatggggcgtt

SEQ ID NO: 64467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctaggctcacgtgcacatacgctgccctg

SEQ ID NO: 64468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctaggggatctgcgatatggccagtttag

SEQ ID NO: 64469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctagtctacaggttgccgggactagcacc

SEQ ID NO: 64470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctagttcagatactggtgcatttagtatc

SEQ ID NO: 64471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctatccaaacggcagtgttgtccttagtt

SEQ ID NO: 64472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctatcgaggttgttttttggtcaccccgg

SEQ ID NO: 64473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctatcgtgattgcgggctgatgcggccgg

SEQ ID NO: 64474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctatctcgtgtgttatgtgggttacgatg

SEQ ID NO: 64475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctatcttaatatgcgtggacccgactcgc

SEQ ID NO: 64476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcaaatcactgctccttggtaagttccg

SEQ ID NO: 64477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcaagacccaagttggtaaagacacgat

SEQ ID NO: 64478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcacaattggcgtgggtatcctacgcac

SEQ ID NO: 64479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcactatctgattccggtcttttcccgt

SEQ ID NO: 64480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcatcgccagaatcgtctttgccagacg

SEQ ID NO: 64481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcatcttgttagatcgcaccaaagggcg

SEQ ID NO: 64482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcatgctcggagtttgtgacactgtcgg

SEQ ID NO: 64483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcattgaattgttttagcctttgcctta

SEQ ID NO: 64484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctccagccgcgttgattccagccttcaca

SEQ ID NO: 64485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctccagtggcatgtgtatgcctgcaggcg

SEQ ID NO: 64486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctccccctaagcttacacatagtacagcg

SEQ ID NO: 64487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcctaaattcgcgagctaatgtcctcat

SEQ ID NO: 64488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcctgatgggctacgataatcagtcggt

SEQ ID NO: 64489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcgagatcgcacatttaattgctctgct

SEQ ID NO: 64490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcgccgggacgcacgcttactcccctac

SEQ ID NO: 64491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcgcctacggagagtcttctacggggtt

SEQ ID NO: 64492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcggaccgtgtggacgcagcgttgtggc

SEQ ID NO: 64493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcggagaggagcccgaccatccatgcgc

SEQ ID NO: 64494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcggtgactgtactcttggcggaatggc

SEQ ID NO: 64495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcggtgatagagttcttgatgtggctgt

SEQ ID NO: 64496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctctagacgaaaccgctctctcccttccg

SEQ ID NO: 64497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctctagacgttcgctgaggaccgatcgct

SEQ ID NO: 64498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctctccacgagtttgtatttgtacccccc

SEQ ID NO: 64499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctctgcgcagaaggggcacgttatcgcgg

SEQ ID NO: 64500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctctgtccgtggctctgtaatttatgtgg

SEQ ID NO: 64501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctcttagctggttagccgatctgcactag

SEQ ID NO: 64502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgaacaattaagccctcaagacaggtgt

SEQ ID NO: 64503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgacagttgggtgtcatgtgcttgttta

SEQ ID NO: 64504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgagtggccctcccaggtcgcatcccgt

SEQ ID NO: 64505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgatgggtttgctgcgccttaccgcgcc

SEQ ID NO: 64506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgcaatatcgcacatttgtaccccgcgt

SEQ ID NO: 64507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgcagggaggtgctcaggatgcttttcg

SEQ ID NO: 64508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgcagttgggttgcattaacagggcatc

SEQ ID NO: 64509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgccctcgataagctctgaccttcagtg

SEQ ID NO: 64510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgccggggttctctacgtctttggacgc

SEQ ID NO: 64511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgcggatatttggtctggtctgtcacgg

SEQ ID NO: 64512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgcggtctagccaacatctcggtccatc

SEQ ID NO: 64513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgcgtatcacatcaatagctgggggtta

SEQ ID NO: 64514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgctggagtgcacaagtttcgccgacgt

SEQ ID NO: 64515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgctggagttttaactaccgaccacccg

SEQ ID NO: 64516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctggcagcttaccacggggctttgcttaa

SEQ ID NO: 64517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctggccgtacatcaagagtcggagtaggc

SEQ ID NO: 64518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctggcgagcgaggccgtaactagacgacg

SEQ ID NO: 64519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtaatcgtacatcccgtaggcgatgat

SEQ ID NO: 64520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtactatgcctccaacactgggagcgc

SEQ ID NO: 64521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtccggtaacataccagctgctcctcc

SEQ ID NO: 64522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtccgttcctcacagccatcctcgcgg

SEQ ID NO: 64523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtcgagcctcagtagtagaccggggcg

SEQ ID NO: 64524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtcggcttcggtgtcgttacttgcacg

SEQ ID NO: 64525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtgcgtaatgcacacagattcatcgtc

SEQ ID NO: 64526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtggccgccactgaacgctatatcggt

SEQ ID NO: 64527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtggttggaaggaacggtgggggcaag

SEQ ID NO: 64528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgtgtacgggcttgctaatggttcggcc

SEQ ID NO: 64529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctgttcgtgcatgtcatacggaatgtagc

SEQ ID NO: 64530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttacacgtctcctgttcatgagctgtac

SEQ ID NO: 64531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttaccggttgcccgtatttatcgagctt

SEQ ID NO: 64532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttagcggcggacttgctgcagttgcgtg

SEQ ID NO: 64533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttatatggaaatcgaggcagttttacaa

SEQ ID NO: 64534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttatcgtggattggcaccaagacgtcgt

SEQ ID NO: 64535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttccaaccggttttacttgtaaccatgg

SEQ ID NO: 64536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttctaggggtccctttcgtcttttagtc

SEQ ID NO: 64537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttgcaacaggtcgcacatgcgcatttct

SEQ ID NO: 64538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttgccggcgggggagaattcaaggcgcg

SEQ ID NO: 64539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttgcctgcgcgttgccctctgaggaagt

SEQ ID NO: 64540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgcttgggtggtcatatgccttagacttttg

SEQ ID NO: 64541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgctttcctcgctacatgcatatttacatgg

SEQ ID NO: 64542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaaacaggaaacttgctgcgatcacgtat

SEQ ID NO: 64543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaaacccagactctttgaggagcgctttg

SEQ ID NO: 64544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaaatccgtgcagacgatccgtgtggttt

SEQ ID NO: 64545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaacaatagagacgtaatcagcgatgcgg

SEQ ID NO: 64546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaaccatcgtagtcatccttgatgacagc

SEQ ID NO: 64547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaactcgattacatcctaggcagtcacgt

SEQ ID NO: 64548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaactttaacccgacaattctcggcatcg

SEQ ID NO: 64549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaagattgcctagcttgtggcgtctagtg

SEQ ID NO: 64550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaagcagcgcgccattagtgatatcgacg

SEQ ID NO: 64551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaagcggaacctggaaatcgcatcaagtt

SEQ ID NO: 64552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaagctgccgttttggtttgtaatccatg

SEQ ID NO: 64553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaatcgtcttaactccggatggcacctgc

SEQ ID NO: 64554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaatgatcgtccggttggacttggtctgc

SEQ ID NO: 64555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaatggccttcgatgatgtgacccgtcct

SEQ ID NO: 64556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaatggtattcgtttgtgtgggttcttga

SEQ ID NO: 64557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaattgcctttctttgtatgttgtagctg

SEQ ID NO: 64558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacactaccaccggtagagcaagccggct

SEQ ID NO: 64559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacagccagctttataacgttacgggcga

SEQ ID NO: 64560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacatcgggagggtcggatggcttgttcg

SEQ ID NO: 64561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacatctctaaattctgaccgttatcagg

SEQ ID NO: 64562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaccaaggtacagcacggccatgcatcgt

SEQ ID NO: 64563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaccactgctctgcgacgcgttgagtagc

SEQ ID NO: 64564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaccagacggataggagggggcactttgc

SEQ ID NO: 64565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaccccggagacgcgaatgtggggaacgg

SEQ ID NO: 64566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacccgcaacaccgcttgttacaataggg

SEQ ID NO: 64567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaccgcgggtggccaggatttgcacaata

SEQ ID NO: 64568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaccgctgaacaccactggcttggctaag

SEQ ID NO: 64569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaccgctgcctgcaacaggtttgtggtat

SEQ ID NO: 64570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacctcagtcggtcggttataacagtatg

SEQ ID NO: 64571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacctgcctcccatacaggtaatctttcc

SEQ ID NO: 64572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacgaacgagtggtaggtcaacagacaag

SEQ ID NO: 64573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacgaataataaaacgttaccttggtctt

SEQ ID NO: 64574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacgagctgacgagagtaccctctgggtt

SEQ ID NO: 64575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacgccctgaggcaaccgttccctgttcg

SEQ ID NO: 64576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacgccgaggaaggcagtggctacagcga

SEQ ID NO: 64577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacgccggtgtcgttttgtacccgcggaa

SEQ ID NO: 64578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacgcgccttaagagtccctgggggggcg

SEQ ID NO: 64579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacgcgttagtggtcagggggtctgtgcc

SEQ ID NO: 64580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacgctaaataactggacgtcagggctgc

SEQ ID NO: 64581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacggacgcgatggtgagcgagggctttg

SEQ ID NO: 64582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacggaggtttgaggcgattcaccactcg

SEQ ID NO: 64583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacgggggctctgcttagctgccatacgc

SEQ ID NO: 64584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacggtaataaatgcgcggctttacgttt

SEQ ID NO: 64585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacggtcggacaagaatcatcgatctcta

SEQ ID NO: 64586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacggtgggaagctcgtctgtctgggtcg

SEQ ID NO: 64587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacgtagttttcttgtgtggcgatccttc

SEQ ID NO: 64588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggactcctgttaggccgtatgttttcctca

SEQ ID NO: 64589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggactggcgtgtgaccgacagaggcttgcg

SEQ ID NO: 64590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggacttggaattggtgcagattatatgcga

SEQ ID NO: 64591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagaacgatctcgcttgttagcgccttcg

SEQ ID NO: 64592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagacagggactatcgatttgccttgttc

SEQ ID NO: 64593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagaccgcgggagagggatagagcaatcg

SEQ ID NO: 64594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagagcaacattttgtgtgtcgcgcgctt

SEQ ID NO: 64595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagattgctgtcaacacctcgctgtgagg

SEQ ID NO: 64596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagcatcggagccgggttgaggaccacgg

SEQ ID NO: 64597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagcgcaataatcctgctaggcgagagag

SEQ ID NO: 64598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagcgggcgctgattccgtttttgaggat

SEQ ID NO: 64599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagcgggtagaagtgcatatgttttgtac

SEQ ID NO: 64600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagctccagagtcctatcgattgctgcgc

SEQ ID NO: 64601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagctgatatgttgtcatcgcctattcta

SEQ ID NO: 64602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagctgtgtcatagcgggtcggcttggag

SEQ ID NO: 64603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaggaatcgtacgatgagtttcgtgtacg

SEQ ID NO: 64604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaggatagcgttagctctgagtcgagctc

SEQ ID NO: 64605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaggcctcgggtgaggattattggccggg

SEQ ID NO: 64606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaggcgaagtactggaacctgagtcttgc

SEQ ID NO: 64607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaggcgagggataaggacgaggttgcgac

SEQ ID NO: 64608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaggcgggtatgggcgaatagaatcgtct

SEQ ID NO: 64609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaggcttcgaacgtttctaaccgttgggg

SEQ ID NO: 64610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagggcgtaacgtgacagggatcaccccc

SEQ ID NO: 64611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagggcgtacaggccccagacggtcaatg

SEQ ID NO: 64612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaggggcgacagccgttctaggtctctaa

SEQ ID NO: 64613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagggggaccggggttacgttctcttgtc

SEQ ID NO: 64614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagggtaggcggaagccggttgaagtttg

SEQ ID NO: 64615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagggtctcggccacggcttgttagggga

SEQ ID NO: 64616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaggtcaaaacaggtggccaggtccctca

SEQ ID NO: 64617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggaggtgtcggcgtcttcttgctcattgtt

SEQ ID NO: 64618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagtagcaaagttgagcgccgcgctacgg

SEQ ID NO: 64619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagtagcacgttgcaccacaccggctcgg

SEQ ID NO: 64620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagtgatcgcgctcgtgaacgccacggtt

SEQ ID NO: 64621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagtgcgttaggttttgtccggttggtgg

SEQ ID NO: 64622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagtgcttcttgttatggccgtgtctcgc

SEQ ID NO: 64623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagtggtgtgattcgacagcttggctaat

SEQ ID NO: 64624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagtgtaagccgtttaggattggacctgg

SEQ ID NO: 64625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagtgtcgagatttggtcggtggggtgcg

SEQ ID NO: 64626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagttacggtaccaagatattgttcagtg

SEQ ID NO: 64627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggagtttgtcgtacaggtcacgatgcactt

SEQ ID NO: 64628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggataattgtccttaaatgattcagacaat

SEQ ID NO: 64629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatacaactcccaagtcggccctccacct

SEQ ID NO: 64630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatacgattcccgcattcttctcgtgatg

SEQ ID NO: 64631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatatgtcgtatcgcgtaatctggttatc

SEQ ID NO: 64632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatattgacagtttcattccgatccgtcg

SEQ ID NO: 64633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatcagggcaggaaagcaccaggcttcat

SEQ ID NO: 64634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatcgcaccgtcgggttcaggatcccttt

SEQ ID NO: 64635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatctaacggcggttaacagtagtatcct

SEQ ID NO: 64636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatgaagtggactgcagatttttgtaccc

SEQ ID NO: 64637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatgatgttcgtcacagacacgtgcaacg

SEQ ID NO: 64638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatgctaagtacttggcggcttcctccga

SEQ ID NO: 64639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggatgggtgggggtgtaaggcaggccgtgg

SEQ ID NO: 64640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaaacggacttccccacagacggctttt

SEQ ID NO: 64641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaaaggcaatcccatgttagctacgctg

SEQ ID NO: 64642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaaaggctcgatccggctaagaagacct

SEQ ID NO: 64643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaaatcggagctatcgccacactcgggc

SEQ ID NO: 64644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaaatgagggatcttaatttagctgttg

SEQ ID NO: 64645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaaccccacagtatggcaagtgctgccg

SEQ ID NO: 64646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaagacgggggcaagtctagtcggtgtc

SEQ ID NO: 64647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaagcgccatttcttaatctgcgtatcg

SEQ ID NO: 64648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaaggggggactaggtatcgggctgtct

SEQ ID NO: 64649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaagggggtccaacgtcattgtggtcgc

SEQ ID NO: 64650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaagtatacgctcatctctcgatgttgg

SEQ ID NO: 64651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaatagtgctttaacgcagacttttcac

SEQ ID NO: 64652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacaacatgttttgattttttggaggcc

SEQ ID NO: 64653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacaactgttgtttgtatcctcgcggca

SEQ ID NO: 64654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacaaggtttcccggccctttggagtcg

SEQ ID NO: 64655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacatccgtcgccagaagattgcatagt

SEQ ID NO: 64656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacgcaattggagtcccacagggagtgt

SEQ ID NO: 64657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacgctactgccatcagaacgcgtatgt

SEQ ID NO: 64658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacggaaattatgtttccatcggatcac

SEQ ID NO: 64659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacggaagtgatattcggcgcggctccg

SEQ ID NO: 64660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacgtcaacactttgatagacactgggc

SEQ ID NO: 64661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcactacaccatgagaacatctgatgtga

SEQ ID NO: 64662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcactcatatgcggcttagttgctgactc

SEQ ID NO: 64663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcactgggaacgtccaagtattgggtaaa

SEQ ID NO: 64664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcacttcaatgaattacatgcttgtccac

SEQ ID NO: 64665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcagagcgaaacctgtagcgatcaatatg

SEQ ID NO: 64666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcagcaccgtccagtacaatgcttgtttg

SEQ ID NO: 64667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcagcatgcttgtagtactatgcccagtg

SEQ ID NO: 64668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcagccgttcgtcaatattatattccttg

SEQ ID NO: 64669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcagcgaagtctgggtaagtgcctcggtg

SEQ ID NO: 64670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcagcgtttgattagtgaaacattgttcg

SEQ ID NO: 64671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcagctggtattgccaacggtgtattaag

SEQ ID NO: 64672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaggagactcaggcatatcgtttaggga

SEQ ID NO: 64673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcagggcgaatcccggcatctctcgcagt

SEQ ID NO: 64674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaggggtgtggactgggctggtgcgtgg

SEQ ID NO: 64675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcaggtccgttacgtataattatcgtcgc

SEQ ID NO: 64676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcagtggcctctgtaagagtcgtgctcgc

SEQ ID NO: 64677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcatacgggcctaacgcgagccatcatcg

SEQ ID NO: 64678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcatcaccggctggatcttgcgctcttct

SEQ ID NO: 64679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcatcagtgttgtcatccttaatccatgg

SEQ ID NO: 64680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcatcatacggcgacggtattctctcggg

SEQ ID NO: 64681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcatgaggcaataggattttccgggagtg

SEQ ID NO: 64682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcatgcttggtctctttacgctcgtatcc

SEQ ID NO: 64683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcatggccttttcctaagtatatccggtt

SEQ ID NO: 64684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcattccaagcatattgcagcctcgcctg

SEQ ID NO: 64685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcattgggatcgtcggaagcatagtcggt

SEQ ID NO: 64686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccaatcccctgttcaggacagtactgtg

SEQ ID NO: 64687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccacacggttgatggggtgcccgcgcta

SEQ ID NO: 64688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccacggtgagggcacgggcgccgtgtcg

SEQ ID NO: 64689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccacgtatatacgtcgttctcgcggatt

SEQ ID NO: 64690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccactgtattactcgggaattggttcac

SEQ ID NO: 64691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccagcatcggttcgtcactgtggtccgc

SEQ ID NO: 64692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcccaaacgttcgcttcacatagcctggt

SEQ ID NO: 64693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcccaccgcatttggtttatccgggtcgt

SEQ ID NO: 64694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccccatgtgagtgacgtcgtaggaacgg

SEQ ID NO: 64695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcccgatgataacgtcgttgtctcgtgca

SEQ ID NO: 64696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcccgcgctcgcagtgtgaaccgactggc

SEQ ID NO: 64697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcccgtaagttagcgcaacactctagctg

SEQ ID NO: 64698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccctcaaattttggttttcgtgcatttg

SEQ ID NO: 64699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccctgaccatgagagtgtaattctgaat

SEQ ID NO: 64700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccctgttcgcctgcgaggcctctgcggt

SEQ ID NO: 64701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcccttacgcggtacttgccttcaactgg

SEQ ID NO: 64702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcccttgaccaccataccaagtctctgtt

SEQ ID NO: 64703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccgagggtttcttgtgcggtggagggtg

SEQ ID NO: 64704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccgagttcgtaatcaggcaatgatcctg

SEQ ID NO: 64705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccgcatcaggcgttaaggaatcattcgt

SEQ ID NO: 64706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccgctcatggtagaattgcctatgcgtt

SEQ ID NO: 64707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccggcaggggtggatagtactgcgcctg

SEQ ID NO: 64708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccggtcatgagcggcagtgttcgttgtt

SEQ ID NO: 64709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccgtcatacttactcatatttctcgcgc

SEQ ID NO: 64710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccgtggtatgatggacggcgattgtttt

SEQ ID NO: 64711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccgtggtggcgcaggggtatcagatgcg

SEQ ID NO: 64712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccgtggttcacagcgtgagtaggcaatg

SEQ ID NO: 64713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccgttcttactagaggcattaacctatg

SEQ ID NO: 64714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcctactcgatcgtgcggatagatctgtt

SEQ ID NO: 64715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcctagaagcacattataacatacgttaa

SEQ ID NO: 64716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcctagtttagttcgggcgcggtcattgc

SEQ ID NO: 64717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcctggttgtgagggcagtgttagatgtg

SEQ ID NO: 64718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcctgtgtagtgctcttccaagtgaggtt

SEQ ID NO: 64719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggccttagcagtttgcaatcgtatgcactg

SEQ ID NO: 64720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgaactggctctcttctggctgcaggtt

SEQ ID NO: 64721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgaagcgggaacaagacgcttagggctg

SEQ ID NO: 64722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgaaggggggtagtaattcgctcagggc

SEQ ID NO: 64723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgacagttatgaaacatcacgcgctaga

SEQ ID NO: 64724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgagcccagctgggtatccgcgttggag

SEQ ID NO: 64725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgaggtatcgtgtctcggcgcgtacgtg

SEQ ID NO: 64726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgaggtccgtcatcaagaactgactcat

SEQ ID NO: 64727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgataaactgatgcaccacgctcaccgg

SEQ ID NO: 64728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgatgaatcgaactctgtacggcttaac

SEQ ID NO: 64729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgcaccatacccggtagcaagctcgtcg

SEQ ID NO: 64730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgcaggcctcgttaatggctcaggactg

SEQ ID NO: 64731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgcatcttgtgtttcagggaaaggtggt

SEQ ID NO: 64732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgccctaaaggatgtccatggaactctc

SEQ ID NO: 64733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgcctcacgtccgtcgacatcgtgccgt

SEQ ID NO: 64734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgcgctcctgaaggaaaacacgggccgg

SEQ ID NO: 64735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgcgtccacgtcgtgagctattacgcgt

SEQ ID NO: 64736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgcgtctatctcgtgggggtcccactca

SEQ ID NO: 64737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgctaaacaacgttctctttggatgctt

SEQ ID NO: 64738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgctgcttcccaggtctggcacccgtgg

SEQ ID NO: 64739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgctgtgcattacagacgatgtgcctgg

SEQ ID NO: 64740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcggagaccggcatatgagcggggtgatg

SEQ ID NO: 64741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcggaggcaacgagggtttccgcttggca

SEQ ID NO: 64742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcggatcggtcagcagattcgacagtgga

SEQ ID NO: 64743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcggcaacgtgcggacaggcatgcatgcg

SEQ ID NO: 64744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcggcaactcatcgttcggcgtgtggttg

SEQ ID NO: 64745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcggctatatgcggtttgttccattcccg

SEQ ID NO: 64746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcggctgggtgcataaggtacggacacgc

SEQ ID NO: 64747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgggcgatattttccaggccagatgttt

SEQ ID NO: 64748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgggcgggcgggaataacacggactcgc

SEQ ID NO: 64749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgggggggtgctctttcgactcggcggg

SEQ ID NO: 64750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgggtagcacgacggagggttagatgcg

SEQ ID NO: 64751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgggtagcgtgccactgtgtcctgatgc

SEQ ID NO: 64752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgggtttatgccatcccagcgcgatcgt

SEQ ID NO: 64753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcggtgtacgtcgtcggacagctgggggg

SEQ ID NO: 64754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtacatccaatggcagtgtcgcatctg

SEQ ID NO: 64755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtaccacacgatgcggttccacactta

SEQ ID NO: 64756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtaggtactgccctctggggtacgagg

SEQ ID NO: 64757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtcaagcgtgccagcaccgccagtcgg

SEQ ID NO: 64758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtcacactaccgtctcgagctttcaag

SEQ ID NO: 64759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtcgttactagtgacctccggggagcg

SEQ ID NO: 64760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtgaggacacctttcactagcgtgtgg

SEQ ID NO: 64761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtggtggtagtctcagtattggtcagc

SEQ ID NO: 64762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtgtcgtttgctgcacaggcccggcgt

SEQ ID NO: 64763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtgtggttgctgggaaggctgggcgca

SEQ ID NO: 64764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtttaggacgtagctcgctggggtctg

SEQ ID NO: 64765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcgtttggacgagtcggtagtatccgcga

SEQ ID NO: 64766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctaacaggctggacttctgactgggcac

SEQ ID NO: 64767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctaacgtgcgcagtgcggacgtgcggta

SEQ ID NO: 64768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctacagacgtcgctcttgctgtacttcg

SEQ ID NO: 64769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctaccggactttgatacaacccatacgg

SEQ ID NO: 64770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctcccgaagtgaggaccattgcgacggg

SEQ ID NO: 64771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctccctggagagttgaccatttgttttg

SEQ ID NO: 64772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctcctggtaactccgcccaacgagaaac

SEQ ID NO: 64773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctcggatgaaggtctgcaatgttagccg

SEQ ID NO: 64774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctctgctgccttcccaagcgcggcctac

SEQ ID NO: 64775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctgaatattccatcctgcagaattggtt

SEQ ID NO: 64776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctgcgcaggatcctaagagtagcttcga

SEQ ID NO: 64777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctgctcgttgacgttctccatgctgcgg

SEQ ID NO: 64778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctggcacatgtttgctttgctctcggcg

SEQ ID NO: 64779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctggcctgcggtagggaatcctccacgg

SEQ ID NO: 64780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctgggacgtaagtcttagcttttgccct

SEQ ID NO: 64781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctgggaggccgtacactgtccagggttt

SEQ ID NO: 64782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctggtggggtcctggctgtcagcggcgt

SEQ ID NO: 64783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctgtcatgcttctatattattttgcccg

SEQ ID NO: 64784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctgtccgtcggaaggtgcatctttacat

SEQ ID NO: 64785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctgtggcgcatacactgcggtttctgct

SEQ ID NO: 64786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcttaaatgggttcggtcaacggagcacg

SEQ ID NO: 64787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcttaagggcccgtgcgaatcgctggttt

SEQ ID NO: 64788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcttagtacaccggatcaccctcaagtct

SEQ ID NO: 64789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcttcacttgcggctttcacaacactctc

SEQ ID NO: 64790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcttcggtgggttagggatacctgataca

SEQ ID NO: 64791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcttgggacgagtcttagcgaacgaggtt

SEQ ID NO: 64792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggcttgtaagtgtcccggtccgtattcctc

SEQ ID NO: 64793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggctttctgctacgtttgggtatgcctagc

SEQ ID NO: 64794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaaagcagtggtcggatgcgtatccgtt

SEQ ID NO: 64795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaaagggccgtaagcttttttgccggat

SEQ ID NO: 64796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaaatcggggacagaaagtagggctgtg

SEQ ID NO: 64797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaaattccctgtggcacaagttacagtt

SEQ ID NO: 64798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaacacgccaaacacaaccgggccgcca

SEQ ID NO: 64799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaagaggcccgtgtttacgatccgcccg

SEQ ID NO: 64800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaataccggaacccgtgtggcgttagac

SEQ ID NO: 64801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaatgtcgggctttctcatctgccgacc

SEQ ID NO: 64802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaattacttctttgcttttcggtccatc

SEQ ID NO: 64803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaatttaatcttttaatacgcggcgtcg

SEQ ID NO: 64804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggacaacggtgggatcatcgccatggtcg

SEQ ID NO: 64805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggacatctttgccagtactcgtggcagcc

SEQ ID NO: 64806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaccagcgtgtcaaagaggccgtcggga

SEQ ID NO: 64807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggaccgggtgggaaatagtttctgacgta

SEQ ID NO: 64808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggacctactctatcacgggacattggtga

SEQ ID NO: 64809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggacgaatttgatcccacacgcctgcttt

SEQ ID NO: 64810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggacgcgccgtggtatttgttccttaagc

SEQ ID NO: 64811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggacgtattccagggtacttcatggctac

SEQ ID NO: 64812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggacgtctggtcgctcgcgccttcgttga

SEQ ID NO: 64813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggactactgtatcagggtgctttggctgg

SEQ ID NO: 64814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggactgggcctttagtatcagccacgatg

SEQ ID NO: 64815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggagaattgacacctacgaaatcaacttg

SEQ ID NO: 64816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggagcgacagcagagtgcaaggtcagcgt

SEQ ID NO: 64817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggagcgatgcccgggcggatgcctggttg

SEQ ID NO: 64818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggagcttcgactagtccccataggcatgg

SEQ ID NO: 64819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggagcttgagcaatattgtacgttcggcc

SEQ ID NO: 64820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggagtctgggtgtgggcgacatggatagt

SEQ ID NO: 64821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggatacgtggctcggtatatgtggtgtgg

SEQ ID NO: 64822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggatcggattgtctgagcgtcgtagtcac

SEQ ID NO: 64823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggatgaacccgcttgtgggttgacgcatg

SEQ ID NO: 64824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggatgcggtaaaagtgattacggggggga

SEQ ID NO: 64825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggatgtagccgagaaagttgctgctgtaa

SEQ ID NO: 64826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggatgttcccgtagatcaaactggccaga

SEQ ID NO: 64827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggatttcggtaattctggggcggtcgctt

SEQ ID NO: 64828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcaacgacttatccacggggtactaagt

SEQ ID NO: 64829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcacaagtcgcctgaacgtcatgccgtc

SEQ ID NO: 64830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcaccactacggtctgtcgtcgggttgg

SEQ ID NO: 64831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcacgttttaaccgtttcacctcgggca

SEQ ID NO: 64832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcagccgatcagaggcggcacggagttt

SEQ ID NO: 64833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcagctccgggcatcgacatcctagtgt

SEQ ID NO: 64834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcaggaggcgatcgttactgctgtgcgg

SEQ ID NO: 64835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcagtccattatgcgtgggtaggtctgc

SEQ ID NO: 64836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcagttgagtacggcagcaccaattttt

SEQ ID NO: 64837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcatacattacaagcgcttagtggacgt

SEQ ID NO: 64838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcatcgcagcggaggtgttttcccgtac

SEQ ID NO: 64839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcatcggcggccgtgaccctgcgtgcga

SEQ ID NO: 64840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcatctaaccatcatgctggctgtgaca

SEQ ID NO: 64841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcatggcctacggcggtcgggggaggcg

SEQ ID NO: 64842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcatgtcgtggtactgactcgcaattgc

SEQ ID NO: 64843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggccagggcatcgggtaatgcttatgtgt

SEQ ID NO: 64844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcccaatcgtgcaatatcctacggtggc

SEQ ID NO: 64845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggccccgtcgagttaccagcaggtttccg

SEQ ID NO: 64846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggccccgtctactttgtgactgcggtgca

SEQ ID NO: 64847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggccgagggtcatgcacgtagggttatgt

SEQ ID NO: 64848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggccgcctaggtcgatggcagcagttccg

SEQ ID NO: 64849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggccttgtgggcaacgaaaacgtcacgat

SEQ ID NO: 64850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcctttcgctagttaccggattatcaat

SEQ ID NO: 64851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcgacttcgctgtcaactcagtggagcg

SEQ ID NO: 64852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcgcaggtcgccttgcgggtgtttggaa

SEQ ID NO: 64853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcgccgctattagtctctcgtggcctcg

SEQ ID NO: 64854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcggaattgggtcgtacagaatggttga

SEQ ID NO: 64855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcggattaagcagcgtcggctagtggac

SEQ ID NO: 64856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcggcgacccgcgcatagcacagttata

SEQ ID NO: 64857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcggcgtgtcacaccagcgcctgcacgg

SEQ ID NO: 64858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcggctcatgagtccggtaacgactggg

SEQ ID NO: 64859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcgggtatccctacggtgtgcagtcgga

SEQ ID NO: 64860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcggtacaagggcgctcgccagtttagc

SEQ ID NO: 64861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcggtgtgaacgtaggggttgactcggt

SEQ ID NO: 64862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcgtagtcaccgtgaccagctcagtatg

SEQ ID NO: 64863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcgtccggagattaggggttcttgctta

SEQ ID NO: 64864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcgtgaagtggtcatgaccgtgggatcg

SEQ ID NO: 64865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcgttggtcgtgtggatgatgggcctgt

SEQ ID NO: 64866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcgtttttcgaaaggaccctaaatcctc

SEQ ID NO: 64867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggctaatgcgtgtacagcaagggtgatca

SEQ ID NO: 64868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggctaattgttggcatgctataccccgcg

SEQ ID NO: 64869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggctatcggaaggcgctacccgcgtgagg

SEQ ID NO: 64870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggctatcttaccgctgagtgtggggacct

SEQ ID NO: 64871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggctcgccgatgatcgtccggggccacta

SEQ ID NO: 64872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggctcgctctcggaaaaggtcgcaatctg

SEQ ID NO: 64873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggctgcaattatatggtgaacgtacgtga

SEQ ID NO: 64874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggctgccatttcgcaatgataagcgtccc

SEQ ID NO: 64875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcttacgtgctactgctctaggcgctat

SEQ ID NO: 64876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcttcggtggtgatggtcttataggccg

SEQ ID NO: 64877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggcttttgcaatcttgttcggtccctgtt

SEQ ID NO: 64878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggaagttgctataggctccctcggcggg

SEQ ID NO: 64879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggacacgtctgagcgttggtccagtttg

SEQ ID NO: 64880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggagacgttttgcccagcttgttttgtc

SEQ ID NO: 64881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggagattcgcaatttcgaacgcggcaac

SEQ ID NO: 64882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggagccgccaaacgcttaaggagacgag

SEQ ID NO: 64883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggatgtatatcatacgtttggccccttg

SEQ ID NO: 64884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggcagtttttgaccaccaagccgggagg

SEQ ID NO: 64885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggcccgtgggattcaccctcggcgtctg

SEQ ID NO: 64886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggcgggtcctcgaaactgatctgttcgt

SEQ ID NO: 64887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggcgtaagtgcgcaggccaaagctcggc

SEQ ID NO: 64888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggcgtccgtgttcccttggctacacgcg

SEQ ID NO: 64889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggctagctcgagtgccgtctcgtactct

SEQ ID NO: 64890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggctctgttggttcactatcacttcaac

SEQ ID NO: 64891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggctgagcgagtaacgcgacaaagctgg

SEQ ID NO: 64892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggggaagcagaccaaccctgtattccgtg

SEQ ID NO: 64893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggggactgcggcgtgctttggtcaaagtg

SEQ ID NO: 64894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggggcagtttcctctcaggtgtttagttt

SEQ ID NO: 64895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggggcgggctggtgggtgaaggtgcctcg

SEQ ID NO: 64896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggggctgattgggtatacatccgtcaagc

SEQ ID NO: 64897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggggctgtcaagttgggcgtccctgtcac

SEQ ID NO: 64898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggggaaagcacggggactcatggccttt

SEQ ID NO: 64899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggggtgcgtgggatagaggggatcgctc

SEQ ID NO: 64900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggggtctgcagctaaggcgtttgggatgt

SEQ ID NO: 64901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggggtggacttggtctggcatcgtcggtt

SEQ ID NO: 64902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggggtggccggtttcaagggaagggttcg

SEQ ID NO: 64903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggtatgctttacggatcaccgagctgcg

SEQ ID NO: 64904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggtcaggtatgaaaagggtcaataattt

SEQ ID NO: 64905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggtgagacatactggtcatcctgcgtgc

SEQ ID NO: 64906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggtgtgtttagtctagtaacccgtgaac

SEQ ID NO: 64907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggtgttgacgctgatcgcttagcatgtc

SEQ ID NO: 64908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggtgttgggtcaacacacttcttgacga

SEQ ID NO: 64909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggttacaaaggggccaatgcataaccac

SEQ ID NO: 64910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggttaccccactggactaggggaaacta

SEQ ID NO: 64911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggttcagttaggtctctttgttacgctc

SEQ ID NO: 64912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggttctgcccacgttacacttcgtttgt

SEQ ID NO: 64913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggggttctgtttgatggtgatcgtacggcg

SEQ ID NO: 64914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtaactcgttttaccgattgcacgtgaa

SEQ ID NO: 64915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtaatggctttgtttacaactttgacgt

SEQ ID NO: 64916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtactctaccggctctgtggcttgttag

SEQ ID NO: 64917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtagaatatcctatcttttgggacgaga

SEQ ID NO: 64918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtagacgagggggggctgattcttctgc

SEQ ID NO: 64919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtagggaagcacatgctcgggtagtgtt

SEQ ID NO: 64920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtatctgttctgctcatggttgtttacc

SEQ ID NO: 64921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtcaaccggaggtgcactagctgtaaag

SEQ ID NO: 64922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtcagtactacagcttgtgtaccggtgg

SEQ ID NO: 64923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtcagtagaaaggtgtgccgctactgtc

SEQ ID NO: 64924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtcatgtctcgtctaggcaagttacaaa

SEQ ID NO: 64925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtccacacggcgcggaacctaagctcgt

SEQ ID NO: 64926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtcgtgtagagcttggatgctgtccgtc

SEQ ID NO: 64927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtgaatcttctaccgttcgagcacttgg

SEQ ID NO: 64928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtgacagcgccggacaatgtggggttaa

SEQ ID NO: 64929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtgagcagagctgctcaggggcggcgct

SEQ ID NO: 64930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtgattggaccgcaggtttcccgtggct

SEQ ID NO: 64931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtgcaatcatctctggtcaggattcctg

SEQ ID NO: 64932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtggaaggtgtggttaaagtgagtccgt

SEQ ID NO: 64933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtggatgtatactgggttctggtttgta

SEQ ID NO: 64934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtgtccagagccgtccatggagttggac

SEQ ID NO: 64935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtgtgggcattcccaaacgtttggcaag

SEQ ID NO: 64936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggttagcaatgacgatacctacatgattg

SEQ ID NO: 64937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggttaggtcgctcggggcccggtaatcgt

SEQ ID NO: 64938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggttcgactattactcgtttgtgttggtg

SEQ ID NO: 64939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggttcgtattgatctctttgagcacagac

SEQ ID NO: 64940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggttgatagtgcttcggtctgttacgtat

SEQ ID NO: 64941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggttggcttcatagaggtcgatttgggct

SEQ ID NO: 64942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggttgtcacagtagggctttgttggctcg

SEQ ID NO: 64943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgggtttcgtagtccgggagcttcgatagtg

SEQ ID NO: 64944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtaaaaaaaattcagagtctgggttatcg

SEQ ID NO: 64945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtaaacacaaaccatcatacgtggtcgac

SEQ ID NO: 64946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtaacgttggcgaaccagtaaggttggct

SEQ ID NO: 64947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtaagggggaggtgtggccgtattcccat

SEQ ID NO: 64948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtaagtgagcggcggtctgaacacctcgc

SEQ ID NO: 64949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtaatcacttcccggctcgtgatcgggtt

SEQ ID NO: 64950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtacaactgaatgcacccacttcactctc

SEQ ID NO: 64951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtacaatggcgtcctcttgccaaggatgg

SEQ ID NO: 64952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtacaggcaaccaccctttatcgcggtcc

SEQ ID NO: 64953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtaccacgattgtacctaattgcagcgtt

SEQ ID NO: 64954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtaccttgggttaagctttttgtatagcc

SEQ ID NO: 64955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtacggtcaaacggtcatacgggccatgg

SEQ ID NO: 64956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtactgatcagccaacctggtcggctaat

SEQ ID NO: 64957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtactgcagttagagtgttattgtcatag

SEQ ID NO: 64958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtagaccagtgttgcagccggtgacgtat

SEQ ID NO: 64959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtagacgggtactggagcgcgaggctgcg

SEQ ID NO: 64960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtagcgtatcatctcctttcctccgaggg

SEQ ID NO: 64961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtagctgagctagtgttgcgccgccaacg

SEQ ID NO: 64962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtagggtgacaaactggattgaccgagat

SEQ ID NO: 64963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtagtagggcgctaccattcgttgttgcg

SEQ ID NO: 64964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtagtttaacggcggttcatttcatccat

SEQ ID NO: 64965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtatatcgggttcagctctttcgtgggcg

SEQ ID NO: 64966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtatgtgtacggtgtcaattgattcatgt

SEQ ID NO: 64967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtattggtcctcgaacacaggcggctagt

SEQ ID NO: 64968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcaaccgaataccagccgagcctgccgc

SEQ ID NO: 64969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcaattatccttgatccagctcaacgaa

SEQ ID NO: 64970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcacatcgacgcactcttaacttggttg

SEQ ID NO: 64971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcactccactgtatcgactgtgctcact

SEQ ID NO: 64972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcactcttaagcttgaatacagtttgtg

SEQ ID NO: 64973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcagagttcgggcactaagtagattgtg

SEQ ID NO: 64974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcagtgtcctccgcgcgatcgttccggc

SEQ ID NO: 64975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtccacggtgattgtgctactggctcggt

SEQ ID NO: 64976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtccagaccaccgctagattagcgaggtt

SEQ ID NO: 64977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtccagcgcctcatcaaaggggtacaatc

SEQ ID NO: 64978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcccgttttctgtaggtgggctgaaggg

SEQ ID NO: 64979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtccgagctgcactatgaaggttggtata

SEQ ID NO: 64980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtccggtgggtcgcccggatactttcagt

SEQ ID NO: 64981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcctcgagggggttgtgcatccacccgg

SEQ ID NO: 64982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcctcggaggtccccttgttcggcacgc

SEQ ID NO: 64983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcctctcgtaccacctcgatgtttcttc

SEQ ID NO: 64984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcctgcatgcaccggtccggctctcgtg

SEQ ID NO: 64985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtccttctcgggcacactgaacgcttcgt

SEQ ID NO: 64986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcgagcaatccgcgcatttaggatcgta

SEQ ID NO: 64987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcggaataaacgtcactatgccaaggtt

SEQ ID NO: 64988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcggattcgcaggctttcctaggggcca

SEQ ID NO: 64989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcggcctgagtttaggaagatgcaccga

SEQ ID NO: 64990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcgtgattacgtgctgcagacttccttc

SEQ ID NO: 64991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcgtggtcaatgcttgtgcttttccgca

SEQ ID NO: 64992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcgtgtgctgaggtcggggtgcaattgc

SEQ ID NO: 64993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtctgcatggaaccttagctaggactctc

SEQ ID NO: 64994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtcttgctcgcggaggtcgccagtgaggg

SEQ ID NO: 64995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgaacacacccgtgtaggattattgtag

SEQ ID NO: 64996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgacggactactagagagagtctgttga

SEQ ID NO: 64997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgaggacaagtaaaagatgtactaggtc

SEQ ID NO: 64998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgagtaaccgctgacggcattcttgacg

SEQ ID NO: 64999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgatgctgaatgaacccggggcttagat

SEQ ID NO: 65000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgatgtgtttccgcgttcctccgggtct

SEQ ID NO: 65001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgcacatctacatcggccagtactgtgg

SEQ ID NO: 65002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgcacgggagtgagcaggtaggggctcg

SEQ ID NO: 65003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgcatcacttcacaattgggtctagcct

SEQ ID NO: 65004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgcccacgcccacattgtacatgcatgc

SEQ ID NO: 65005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgcccttgttgcctgaggctactctgta

SEQ ID NO: 65006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgccggatgcgatgttgacgcctccact

SEQ ID NO: 65007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgcgaatacaggtaccgcttgggccgcc

SEQ ID NO: 65008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgcgactcagcatttacaagcgtactgg

SEQ ID NO: 65009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgcgtcggtggagcggttatgggtggcg

SEQ ID NO: 65010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgctgtgtatgcgcgtatatgacggtcg

SEQ ID NO: 65011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggacaagtgcccggcacgtcgtaatcg

SEQ ID NO: 65012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggacatagcgcggttcggcgatccggc

SEQ ID NO: 65013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggactactgcgcggtatccctaagcat

SEQ ID NO: 65014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggactatgcggttcggaaaacttatat

SEQ ID NO: 65015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggagagccgcaaggcgcagcgcaagtc

SEQ ID NO: 65016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggagatggagagtctggaccgatcacg

SEQ ID NO: 65017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggagcttactggcgtgattgaactgcg

SEQ ID NO: 65018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggagggaacggcaagcgccatcatgtc

SEQ ID NO: 65019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggccggcagcggtattacaaacagatg

SEQ ID NO: 65020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggccgtccatcgcaagcgggttgagcg

SEQ ID NO: 65021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggcctggttctgccgagaggcctcggg

SEQ ID NO: 65022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggctgtagcgcgcgaatgtctacccct

SEQ ID NO: 65023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgggcattagtttaaccgcgttatctga

SEQ ID NO: 65024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggtaacgtctcgggtgtacatgtaaca

SEQ ID NO: 65025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggtcgctccagtccataggtagcctgt

SEQ ID NO: 65026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggtgatccgtttctcagattacatcca

SEQ ID NO: 65027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtggtggcttgtggcgggaatcaccccat

SEQ ID NO: 65028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtacgggccccgagcttgccggctgaa

SEQ ID NO: 65029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtagcttcgccgcaaaaacaggcgcca

SEQ ID NO: 65030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtatcgtgataacggcgcggtgagtgg

SEQ ID NO: 65031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtcagcagcctcgaggttcattaacgg

SEQ ID NO: 65032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtcgcgtttctgtgtttattttctctt

SEQ ID NO: 65033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtctcctgattccacctgtcgacgcga

SEQ ID NO: 65034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtgaacggacagtgtcagccaagctcc

SEQ ID NO: 65035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtgccaacttccggtattcggatcggg

SEQ ID NO: 65036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtggcgctgtttgaaacttcaacgtct

SEQ ID NO: 65037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgtgtgatggggacgtgttactgcgcaa

SEQ ID NO: 65038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgttagttcactatgctggggttagcga

SEQ ID NO: 65039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtgttggcggacagggatccgtacagccg

SEQ ID NO: 65040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttaaacacactgacgcacctaagtgtcc

SEQ ID NO: 65041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttaacgggagttcggctgtgaccctggt

SEQ ID NO: 65042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttaatccagtgcggtaagcccggtgttt

SEQ ID NO: 65043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttactgttgtttagcacaatccgcgttc

SEQ ID NO: 65044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttaggacagacttatttggtgaatctta

SEQ ID NO: 65045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttatgcatttagctggctagccagtgcc

SEQ ID NO: 65046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttcactagctccggcacgccgatagtcc

SEQ ID NO: 65047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttcagaggtaaacatcctctcagcagat

SEQ ID NO: 65048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttccgaaatgagccctccccgtacaatt

SEQ ID NO: 65049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttcgaacttcaccagtggacgtgttcga

SEQ ID NO: 65050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttcggcgaggtttagagtacatgggtgc

SEQ ID NO: 65051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttgagggtcggcatcgactgtgcatgta

SEQ ID NO: 65052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttgcacaattccgcctcgtttcgaacat

SEQ ID NO: 65053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttgcgcgtgctccgatgtagtttgacat

SEQ ID NO: 65054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttgcggggggtagcgaacaaacagggta

SEQ ID NO: 65055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttggcccaccacaaaggcatgggtttcg

SEQ ID NO: 65056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttgggctcggcgggatgaggtggccgga

SEQ ID NO: 65057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttggtagagcgtaagctatggccggtaa

SEQ ID NO: 65058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttgtggtatagagtgtgcggttcggccg

SEQ ID NO: 65059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggttgttggtgcagggggtgctgggttgtg

SEQ ID NO: 65060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtttaaatggcttggagcgttactggttt

SEQ ID NO: 65061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtttaacgttacgttaagcctatttgttg

SEQ ID NO: 65062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtttaagttcatgggctccgtgacaggaa

SEQ ID NO: 65063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtttatattggatggcttggggatgatgc

SEQ ID NO: 65064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtttcgctcgcataaatggattttgcctt

SEQ ID NO: 65065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtttcggggtggcactgtaaacatccgtg

SEQ ID NO: 65066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcggtttcgttcggttagtttgaccagtgcgc

SEQ ID NO: 65067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaaagacgacgtggcccatacgctccttg

SEQ ID NO: 65068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaaaggcacacgtgggcaggattgcaccc

SEQ ID NO: 65069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaacaaagcacatcatgcaggcggtgtat

SEQ ID NO: 65070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaacaggcactttaatggcggtagttaaa

SEQ ID NO: 65071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaacagttggtgatgcaatatagctttaa

SEQ ID NO: 65072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaaccccagtgcaaccggaggcagtcttt

SEQ ID NO: 65073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaagcaagatcgctgaggaagaggaccgt

SEQ ID NO: 65074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaagtcctatcaccaagctaacagtcggg

SEQ ID NO: 65075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaatcatagcggcaaaaggggatggaagg

SEQ ID NO: 65076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaatggctacttggattggagaaattggc

SEQ ID NO: 65077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacaacgtctctgcgccagttacctaagt

SEQ ID NO: 65078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacactggacggagatcgtatcgttacgt

SEQ ID NO: 65079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacagaactgcccgcgacaatgggtctag

SEQ ID NO: 65080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacagcgggtgcggaaccgagttcggatt

SEQ ID NO: 65081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacagttcgctacctagtctggcacctct

SEQ ID NO: 65082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacccaaagatttctggtaaatagggact

SEQ ID NO: 65083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacgattgaagaggcccctgtcgctgggt

SEQ ID NO: 65084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacgccagtatttaccataagtctgtatg

SEQ ID NO: 65085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacgcttccctgcaagtaaggccgtcttg

SEQ ID NO: 65086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacggcgtcgcagtttcgatcgcagcata

SEQ ID NO: 65087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtacgtaacgagtgacccaggcacaggtgt

SEQ ID NO: 65088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtactagtgtcgtacggggaatgagttctg

SEQ ID NO: 65089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtactcgcaactataggatctccggtcttc

SEQ ID NO: 65090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtactgtgatttcttaacgtgcttgggctg

SEQ ID NO: 65091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagaacgagagacgacgggactagttatc

SEQ ID NO: 65092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagagacgggacactcggatggcttcggt

SEQ ID NO: 65093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagagcgtccatgaatggctggcttaggg

SEQ ID NO: 65094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagatgtgcgactccttcatgctggtatc

SEQ ID NO: 65095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagcagcttattctacggcactttctttc

SEQ ID NO: 65096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagcagtatccccggactctagaccttta

SEQ ID NO: 65097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagccataggttattactagtgagtgtga

SEQ ID NO: 65098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagcgcacaatacagtgttaccagccagg

SEQ ID NO: 65099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagctgtgtggtgtgcgcctgattatttc

SEQ ID NO: 65100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaggcaaaagaagtgcgcgaggacgtgat

SEQ ID NO: 65101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagggggatagcagcggtaatggtgaggt

SEQ ID NO: 65102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtaggtgcatccgtaccattggaacagcac

SEQ ID NO: 65103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagtagcattttgtctccaagtggaatgc

SEQ ID NO: 65104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagtatgacggctacgcgctgcagccatg

SEQ ID NO: 65105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtagttggaatacctttccctttcgtccgt

SEQ ID NO: 65106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtataaaccggcgttgtcgtagagttttca

SEQ ID NO: 65107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtataatttacgttgtgttaagtgtcttcc

SEQ ID NO: 65108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtatcaggagacactctagggtcttttggt

SEQ ID NO: 65109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtatgcgtggttatccgtgtctatacggct

SEQ ID NO: 65110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtatggaagtcactcccaagctcccgtatg

SEQ ID NO: 65111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtattgcgatttcaaaggtgtcggtccggc

SEQ ID NO: 65112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtattgtttgctcagtgttagcccttccgt

SEQ ID NO: 65113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcaactcgccagagagccggagcagcggt

SEQ ID NO: 65114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcaccaaatcagcagtggtaacagtgacc

SEQ ID NO: 65115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcaccgtacaaggttgattgccacttgtc

SEQ ID NO: 65116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcacggcgctgacccggtaatctaacctt

SEQ ID NO: 65117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcagctcttccaattcggccaggaaagta

SEQ ID NO: 65118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcagcttgttcggatctgggactctacgc

SEQ ID NO: 65119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcaggcgccgctgatgcttaactgatttg

SEQ ID NO: 65120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcagtatcaatcaatgggccacaccgtta

SEQ ID NO: 65121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcatctcggggtgttctttcagggttgtc

SEQ ID NO: 65122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcatgcagagcgtgagataggtgccaggc

SEQ ID NO: 65123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcatggaaggtgtggacgtcatgtgggtg

SEQ ID NO: 65124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcatgtgcatcgtttttgtggcgggatcg

SEQ ID NO: 65125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcattacacccatagcgcggccgcagggc

SEQ ID NO: 65126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcattcggggtctgtcgttgcaactttta

SEQ ID NO: 65127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtccatgcattccggccctaccatattgtt

SEQ ID NO: 65128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcccacgccagttgatacgaatcatgttt

SEQ ID NO: 65129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcccaggttttatggtccaatttgttagc

SEQ ID NO: 65130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcccggtagtcacctggcgttggccaatc

SEQ ID NO: 65131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtccgacttcttcattgcaccgtacttagt

SEQ ID NO: 65132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtccgagcttccggtctcacgctggtcacc

SEQ ID NO: 65133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtccggctgatcccatgaccggtgggtgtg

SEQ ID NO: 65134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtccggtgcagctcagcgactgttcacatg

SEQ ID NO: 65135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtccgtcgttgatgaatcgtatcacagcga

SEQ ID NO: 65136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcctgattcggtgcacaccttagctggat

SEQ ID NO: 65137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcctgctgaacggttaaccaatcacgctt

SEQ ID NO: 65138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtccttccgatcatagtttagcgatgggga

SEQ ID NO: 65139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtccttccttagggctcgaacaggtatacg

SEQ ID NO: 65140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcgactcattttcttcgggcagcgacacc

SEQ ID NO: 65141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcgcagaccctcaacattgattttcttga

SEQ ID NO: 65142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcgcgctcgttaattggttgtgtaccctc

SEQ ID NO: 65143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcgcgtacaagttaaggggctttagggac

SEQ ID NO: 65144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcgcgtaggatgtgatagatattaggagg

SEQ ID NO: 65145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcgctggttagatctccggggcgaattgt

SEQ ID NO: 65146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcggaatggacgtagtctaacatagctgg

SEQ ID NO: 65147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcggatcctcttcttatccttaaaatttt

SEQ ID NO: 65148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcggcaagtacgtcggatccttttgcaat

SEQ ID NO: 65149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcggcacaccgtagtctttgtgcgagtac

SEQ ID NO: 65150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcggcatgcccgtggagtcagaatcgggc

SEQ ID NO: 65151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcgggccctgtttctgtttcccacacggt

SEQ ID NO: 65152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcgggctaatctgtcgaacaggctgctcg

SEQ ID NO: 65153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcggtcgccattctttacatcgtttatct

SEQ ID NO: 65154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcgtcgatctcctgttgacctagcctgtc

SEQ ID NO: 65155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcgtgttatttaattggccttatttgttc

SEQ ID NO: 65156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcgttctggtacgtgaggttcggctctct

SEQ ID NO: 65157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtctactcgagaggtcgatccggttgagcg

SEQ ID NO: 65158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtctattaggtgctgggaagatccataaga

SEQ ID NO: 65159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtctcgtccgctggccaggcgctccggccc

SEQ ID NO: 65160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtctcgttttatcgtacttcacgattttgc

SEQ ID NO: 65161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtctgatcgtctactgggcatggccattcc

SEQ ID NO: 65162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtctggcggtacttcgatgagtgtagaatg

SEQ ID NO: 65163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcttatccggcgttgcggttgtttgctcc

SEQ ID NO: 65164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtcttatgaggaactgcaaagatggattcc

SEQ ID NO: 65165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtctttccttcgcggtccttgggttgatcg

SEQ ID NO: 65166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgaacaatctttgtcgctaacctgattgt

SEQ ID NO: 65167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgaacgggctccgcggattgaggcttgtg

SEQ ID NO: 65168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgacaactcttcataacggacgtttatct

SEQ ID NO: 65169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgacagagctgatagatcggtggctccgg

SEQ ID NO: 65170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgacgagttgcgcggtcgcattcggtcaa

SEQ ID NO: 65171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgacttcgtgtcaagacagggttgagggg

SEQ ID NO: 65172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgagaacacgctcaatttcttgcgtaacg

SEQ ID NO: 65173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgagacgggctcggttagtgtcattggtg

SEQ ID NO: 65174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgagatggctcgggtggtgtcttcctgtt

SEQ ID NO: 65175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgaggaaaatgtaaacttacgcacgggca

SEQ ID NO: 65176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgaggacgaagcccatatcaatcccttgg

SEQ ID NO: 65177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgagggcatcgcggccttgctttatggca

SEQ ID NO: 65178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgagtagtgggcgtattttgggtgaccat

SEQ ID NO: 65179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgagtgagtcttgatctctgcgctgattc

SEQ ID NO: 65180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgatatgagatacccaaggttggtaacga

SEQ ID NO: 65181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgatcatcctgcacccccggccccattcc

SEQ ID NO: 65182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgatgagtcggggttagtcgagtgggtcc

SEQ ID NO: 65183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgatgcagtcatatacaaccttgattagt

SEQ ID NO: 65184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgatggtccggcttggttggttgcccaag

SEQ ID NO: 65185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgatgttagtggcgtggttcctctggtcc

SEQ ID NO: 65186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcaaggggggcgaaccataaagccacgt

SEQ ID NO: 65187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcactacgttaagctcctttcattcaac

SEQ ID NO: 65188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcaggatttgcgactcccgggtatggat

SEQ ID NO: 65189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcaggcgtcatattgatccttatctcta

SEQ ID NO: 65190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcagtacgtgatccgacccacgcgacac

SEQ ID NO: 65191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcatatcacacccccactatcgaatctg

SEQ ID NO: 65192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgccatggggcattaggcaaaatccaccg

SEQ ID NO: 65193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcccccagtcgtatgatcgaaggcttcg

SEQ ID NO: 65194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgccctgacagtagggattgggtaatcgg

SEQ ID NO: 65195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgccggatgtctgtgggtcttcgatgcat

SEQ ID NO: 65196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgccgtaaggaactgaatttggcatactg

SEQ ID NO: 65197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgccgttgtggtcttgctgacctgtcatc

SEQ ID NO: 65198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgccttcctcgccgggttgtgtgtggagt

SEQ ID NO: 65199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcgaagacagtgccgtgcagagcggtgt

SEQ ID NO: 65200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcgatcaacgttccagcggggagagtgg

SEQ ID NO: 65201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcgcagaagggcgtagttccggacgcgg

SEQ ID NO: 65202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcgcattctcgttgatcctgggataggt

SEQ ID NO: 65203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcggactcagtggcgctattttacgtca

SEQ ID NO: 65204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcggcagcttggtagaccctcgtatctg

SEQ ID NO: 65205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcggcgcaaacaaacacggatatcagtt

SEQ ID NO: 65206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcggcgtgttccaaggtatatgtagggt

SEQ ID NO: 65207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcgttagattaactattggaaccctatg

SEQ ID NO: 65208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgctacgggttcattcaatgactacgctg

SEQ ID NO: 65209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgctcggcgttctgacgcgtcctggatct

SEQ ID NO: 65210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgctcttaatatttatagcgcctggtttg

SEQ ID NO: 65211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgctgtgtgattgttctactgcgagtggg

SEQ ID NO: 65212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgcttcatcccccgatttcttgtcactgc

SEQ ID NO: 65213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggaactgaaaagatcacgtagtgacgtt

SEQ ID NO: 65214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggaagggggtcgcagtcagtgggccatg

SEQ ID NO: 65215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggacactacgctaggcgggagactatcg

SEQ ID NO: 65216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggacagtgcttttaattctccgtaatcg

SEQ ID NO: 65217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggagccgtctccagatgaacgtcaggtg

SEQ ID NO: 65218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggaggctgacgttggtgttaataatttg

SEQ ID NO: 65219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggatagtatggctacgatgggtagacgt

SEQ ID NO: 65220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggattgaccggcctagtagggtaacgtg

SEQ ID NO: 65221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggcagggagtgactgtgtccttcaggct

SEQ ID NO: 65222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggcatgcaacgctagaacgggaatccgg

SEQ ID NO: 65223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggccatccacacaagttatctttgctgg

SEQ ID NO: 65224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggccatggctgattccctcgtagtctta

SEQ ID NO: 65225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggcgtgttaaccgtaattgctggtttgt

SEQ ID NO: 65226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgggaaggtggtgggtcttgtgcctcacg

SEQ ID NO: 65227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgggaataggcgagctcactgtttggggt

SEQ ID NO: 65228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgggcattatatcctacgatgtacttagt

SEQ ID NO: 65229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgggcgatgctgattaggcgggactgtgc

SEQ ID NO: 65230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggggcgagtcactgcatagacagtcgtg

SEQ ID NO: 65231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgggtgtcggtttataatcccaagcctgt

SEQ ID NO: 65232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggtagcgtaaatctatattggttttacc

SEQ ID NO: 65233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggtatcactctcgcagaaccgagggtat

SEQ ID NO: 65234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggtatttcgttttgcatactggttatct

SEQ ID NO: 65235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggtgaacgttgttgggttttggtccaag

SEQ ID NO: 65236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggtgggggccaaccgcttcacctgtatg

SEQ ID NO: 65237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggtgtggcttcaatgatgtttggcgtcg

SEQ ID NO: 65238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtggttgtagttctgaaaccctgtgcgatt

SEQ ID NO: 65239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtaacgcatttggcatggggtgagcatc

SEQ ID NO: 65240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtactcgttacacagggggtagaaggtc

SEQ ID NO: 65241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtatccactgagtgcggcaatttgattc

SEQ ID NO: 65242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtcatggtctctcactctccactcctcc

SEQ ID NO: 65243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtccgagttgatgggacatcttcctctc

SEQ ID NO: 65244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtcgaatgtgtattgcgtatggccccaa

SEQ ID NO: 65245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtcgatgtgcagggggtagggcaaatgg

SEQ ID NO: 65246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtctatatgctgccgcgagattcgaggt

SEQ ID NO: 65247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtgcagatcgaagcccttgctggtacgg

SEQ ID NO: 65248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtgcagcgcagttgtaacattcttgtcg

SEQ ID NO: 65249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtgcagtatgcagtcatctgacctgtct

SEQ ID NO: 65250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtgctaccccgtgtattttccgcgttgc

SEQ ID NO: 65251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtgtcctgccgataggtttttgccagtc

SEQ ID NO: 65252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtgtctaccccgcaaaaggcatgttgca

SEQ ID NO: 65253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtgtttggcgatggtcgtttctcgttatag

SEQ ID NO: 65254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttaaagtttgcgtacagagtttttaaagg

SEQ ID NO: 65255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttaaggttcagtggattgcgggccagggg

SEQ ID NO: 65256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttaatcacttgactaatattgggcttcca

SEQ ID NO: 65257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttacattcggaattgtcccattgtggcct

SEQ ID NO: 65258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttaccgggtatccgctcaacgttcactcc

SEQ ID NO: 65259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttacgaagtcgtacagatatcgggaccta

SEQ ID NO: 65260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttacgcggatgtttgatcgtatctacagg

SEQ ID NO: 65261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttacgcgggaagatgtgggtaggctacgc

SEQ ID NO: 65262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttacgttttctctcgtcatcgtgatcacg

SEQ ID NO: 65263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttagacgcatggcatattgtaggactctg

SEQ ID NO: 65264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttaggcagctcaacacgatgcggtggccc

SEQ ID NO: 65265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttatatcacgggctatcggctagctgcgg

SEQ ID NO: 65266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttatcccacaagctgtcatttacttcttc

SEQ ID NO: 65267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttatgagaactaagaacctgttcatcgag

SEQ ID NO: 65268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttattcttatcatttcacgtagcgtcttc

SEQ ID NO: 65269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttattgccctagggttggtttgcgcaggg

SEQ ID NO: 65270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttattgtcgcgcgattcggacctacgggt

SEQ ID NO: 65271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcaaaagtcagctcttggggaaaggggg

SEQ ID NO: 65272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcaagagtcgtgcgtgttgagtgccaag

SEQ ID NO: 65273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcacaactctttcgcgccagccttagcg

SEQ ID NO: 65274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcaccagtgtgtgactcctcggtctcaa

SEQ ID NO: 65275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcagctccgtcggtagaccgtcgcggtg

SEQ ID NO: 65276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcatgacggtgcggccatctatgacatg

SEQ ID NO: 65277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcatgtgttatgagggtcaaggcatggc

SEQ ID NO: 65278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcccgcagaattggggctcagtccaggg

SEQ ID NO: 65279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcccgcgctattacctcctacggtttgg

SEQ ID NO: 65280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcccgcggaaagcgctgtggccgatcgc

SEQ ID NO: 65281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttccgggtgttcaacaatccagatgtgtt

SEQ ID NO: 65282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttccgttcgtggtatccagtagtcggtcg

SEQ ID NO: 65283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcgaggaaatcatcgtatgaggttacat

SEQ ID NO: 65284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcgcctttggcgcataggggataaagca

SEQ ID NO: 65285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcggatgacctgacgaccaaggttggcg

SEQ ID NO: 65286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcgggagcgacggtttactttgcactcg

SEQ ID NO: 65287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcgtaaccaggatagcggttggatgtac

SEQ ID NO: 65288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcgttctaggatggttcttaatttgcgg

SEQ ID NO: 65289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcgttttccttttacagctggcttaagg

SEQ ID NO: 65290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttctatcttgcgtcttcgatagcgcttag

SEQ ID NO: 65291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttctctatcgagtttgcgtatctgcttgt

SEQ ID NO: 65292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttctgaggactggacacgctacctgttct

SEQ ID NO: 65293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttcttgacactaggatgttgagtgcgagt

SEQ ID NO: 65294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgaacgctcgtgtgtacatcgcccctcg

SEQ ID NO: 65295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgacaattggttactatattttgccgtg

SEQ ID NO: 65296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgaccctttacagctctgctttttcctc

SEQ ID NO: 65297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgactggcacagggcagtagtgacgatc

SEQ ID NO: 65298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgatactaaacaggggtggagatgtcgt

SEQ ID NO: 65299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgatccggttgcaatgtgcatgaactgc

SEQ ID NO: 65300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgccataccgaaggagttgtcaggccgt

SEQ ID NO: 65301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgcgacatcccaaaggtgcatctgttgc

SEQ ID NO: 65302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgcgcatatcttgggtcgtggtcacgcc

SEQ ID NO: 65303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgcggatgtcaaattcaggccttatgct

SEQ ID NO: 65304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgcgtgcccgcgttgggtgcttggattc

SEQ ID NO: 65305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttggcgcaggcttagcttggcgggttcgc

SEQ ID NO: 65306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttggctagtactgttatttcatatatctg

SEQ ID NO: 65307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttggcttcctcctcggtttggttcgttcg

SEQ ID NO: 65308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgggtcgacgctcaaccgggagtaagag

SEQ ID NO: 65309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttggtaatgcgctttgtacattcgttagt

SEQ ID NO: 65310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttggtatgcgatcagcttggtacgcgccg

SEQ ID NO: 65311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgtaccctaacatcaaaccgattccatg

SEQ ID NO: 65312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgtcgttcatcatgcgcgcgacgtcttc

SEQ ID NO: 65313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgtgcgaggttcttcagcacctgctcga

SEQ ID NO: 65314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgtgtgacaagtgaaaaggcgtggtaat

SEQ ID NO: 65315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttgttttctgaaacggctagttccatgtt

SEQ ID NO: 65316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttaaacgtgcgtcgagagagtggtttgg

SEQ ID NO: 65317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttacaacaaggatacctatggatgctgc

SEQ ID NO: 65318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttaccttgtagtatgtgggggccgttta

SEQ ID NO: 65319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttagtgaaaggtcgatatttcgagtttg

SEQ ID NO: 65320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttattgtggtgtctatcagccgggacta

SEQ ID NO: 65321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttcattcaccggcgtcaccacgttagtc

SEQ ID NO: 65322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttcttgctcaaggtaaagatctctaaca

SEQ ID NO: 65323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttgcacactaactgggatcggtcccacc

SEQ ID NO: 65324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttgcggcggtgctttagcaactagttgc

SEQ ID NO: 65325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttggtttcagcacgcgttactgcggtca

SEQ ID NO: 65326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttgtaccccttggcttccgtacgtgggt

SEQ ID NO: 65327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttgtatccgccgcagtattgcaattagc

SEQ ID NO: 65328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttgtctgactgtaaatctatgcgtcttg

SEQ ID NO: 65329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgtttgtgcggtggtcggtaagcagctgtta

SEQ ID NO: 65330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcgttttaaatttatcaagtactaggtttcaa

SEQ ID NO: 65331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaaagatcgagcggtgattgattatctgg

SEQ ID NO: 65332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaacatggtctcctagacagaaacctcta

SEQ ID NO: 65333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaacgcgtaatgtctgcttgcattgggat

SEQ ID NO: 65334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaacggcgtgatggtcaacccgactagtt

SEQ ID NO: 65335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaagaaccttatctgtcggcggtcgctgg

SEQ ID NO: 65336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaagaggagagcggcaagcgtttaatcct

SEQ ID NO: 65337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaagcaggaacgcgttcccatggcgactg

SEQ ID NO: 65338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacacacctcgctaatgtaaaaattcgta

SEQ ID NO: 65339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacagtttactgagacggatagttcagcg

SEQ ID NO: 65340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacccgggagatcctagtcctagtttcga

SEQ ID NO: 65341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaccgggtacaaaatgcttggacttgcct

SEQ ID NO: 65342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaccgtactccatcggctttcacacggac

SEQ ID NO: 65343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacctggtccgattcgttcaatgctagca

SEQ ID NO: 65344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacgagcacggagttacgggttactttct

SEQ ID NO: 65345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacggcaaagttcaaagcgttctctgtgc

SEQ ID NO: 65346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacggcgacatagcggtatcaccacggaa

SEQ ID NO: 65347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacggctcggatcattgtcagggaattaa

SEQ ID NO: 65348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacggttgctcttgccacatacgttgtcg

SEQ ID NO: 65349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaacgtctgtggctacgtagagacctctgg

SEQ ID NO: 65350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaactaacctgactccatgtggttggtagg

SEQ ID NO: 65351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaactgggactgaatcgcacggttgaacat

SEQ ID NO: 65352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaagccgcggctacttcatagtccccacaa

SEQ ID NO: 65353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaagcgtggccgaattcatttgcgttcgtt

SEQ ID NO: 65354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaagctacctgtatagccgttcactgcagt

SEQ ID NO: 65355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaagggccctttcgtgctaaaaccctacat

SEQ ID NO: 65356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaaggtaacctaagtcttaagtgaagggga

SEQ ID NO: 65357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaagtccggtcgtttaatcacactagtcgg

SEQ ID NO: 65358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaagtgggtagtgagggtcgcaccattcga

SEQ ID NO: 65359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaagttcccggggaggatctttcccgcgcc

SEQ ID NO: 65360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaatcccggcccaggtggattttctagtgg

SEQ ID NO: 65361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaattaaccgtgattcgactaggtttatgt

SEQ ID NO: 65362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacaaaggacaccagatgttgtttaccgtc

SEQ ID NO: 65363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacaactctgtggcagcaccgattactcgc

SEQ ID NO: 65364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacaatcctgcgggctcccttcgaagtcgt

SEQ ID NO: 65365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacacaaatagatgtaaagagagctggccc

SEQ ID NO: 65366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacacaagcggtatgtcggcaatgttatag

SEQ ID NO: 65367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacaccgacggctaaatgaccccgcgcgag

SEQ ID NO: 65368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacacgtatactatatgctgctttagcatg

SEQ ID NO: 65369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacagaaattagattttcccgaaggtcccg

SEQ ID NO: 65370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacagactatgcccgccctgctggacaccc

SEQ ID NO: 65371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacagaggactaactggacgagactgtagt

SEQ ID NO: 65372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacagctctaacttaacaacacattccggc

SEQ ID NO: 65373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacatgcagtacgtggtcccgcctcgccca

SEQ ID NO: 65374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacattgggggtggtgaagtgaagcaccgc

SEQ ID NO: 65375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccacacggtcggtagtttcggttcaccg

SEQ ID NO: 65376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccacctctccgactctcgttcttcaccc

SEQ ID NO: 65377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccactactcgccttatgggtgacgaact

SEQ ID NO: 65378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccactcactcggtgtacttatcggtact

SEQ ID NO: 65379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccagggtaatgcggtcgaatggagcgga

SEQ ID NO: 65380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccccggttggcacgcttacttgccaggt

SEQ ID NO: 65381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccccgttgagccctgggcgcggtcacga

SEQ ID NO: 65382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccgcccggtaattactcgatacacccta

SEQ ID NO: 65383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccgctagccttccggacactgtgcgtgt

SEQ ID NO: 65384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccggacaacgatgatctaacggggggat

SEQ ID NO: 65385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccgggatcccgttagcaggttcgagacc

SEQ ID NO: 65386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccggggttgacaaaactatgcgtggatc

SEQ ID NO: 65387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaccgttgacagcccaacttgtgatctctg

SEQ ID NO: 65388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacctacgtaccacgttcttcgaacgccgt

SEQ ID NO: 65389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacctcggggtgcctgcgattgccttcttc

SEQ ID NO: 65390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacctttcccgctgtatcggtgtggtgatc

SEQ ID NO: 65391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgaaaaactttacgcggggggatccgtc

SEQ ID NO: 65392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgaattttatacaaagtcgcccggcatt

SEQ ID NO: 65393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgcactgccttcaggttgagtgcaggtc

SEQ ID NO: 65394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgcggagtttgaacccgaattcttagtc

SEQ ID NO: 65395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgctcccggttcaatgtcatgcgtcact

SEQ ID NO: 65396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacggactgttaccttagggtcgcccaccg

SEQ ID NO: 65397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgggactggcttatacttgaagggcgtt

SEQ ID NO: 65398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacggggatccggggaaggttcatcacgcc

SEQ ID NO: 65399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgggggtagcatcgaggttcgttttgtt

SEQ ID NO: 65400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgggtcgccaaaatgcgggcgaggccca

SEQ ID NO: 65401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacggtagccgcccagtcctacggcgcact

SEQ ID NO: 65402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgtattctctgaagaattaagatcaacg

SEQ ID NO: 65403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacgtttcaataggcgcctcgtttcttgga

SEQ ID NO: 65404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctactacaccaaccatggtaagtaatccctg

SEQ ID NO: 65405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctactcagacggcagcttgttgtccatgctc

SEQ ID NO: 65406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctactctacatttgtgacttggacattgagc

SEQ ID NO: 65407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctactgcgcacctacaaccctgtcctgacga

SEQ ID NO: 65408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctactggggatgggacgggtggaatggcagc

SEQ ID NO: 65409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctactgtactaattcgggaatgagtttgttg

SEQ ID NO: 65410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacttgcatgtgttatttttattcggcaac

SEQ ID NO: 65411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctacttgtcaacattcagaggcccatgcccc

SEQ ID NO: 65412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagaaatcgtgctgttgagtgtaggactgc

SEQ ID NO: 65413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagacataacttttaggcatcgcaacccgg

SEQ ID NO: 65414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagacggagaattttatttaagagatattg

SEQ ID NO: 65415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagacggcgtttaacgtcatgctttatcgg

SEQ ID NO: 65416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagacttctgtagtcatttagtggaggttg

SEQ ID NO: 65417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagagggcagaaagaagttcctactgacac

SEQ ID NO: 65418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagatccacttaaccgatggacggactagt

SEQ ID NO: 65419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagatggtcttagggggtgtcattccaata

SEQ ID NO: 65420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagcaaatgtacactctgaccacataacgc

SEQ ID NO: 65421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagcaccctgcattgatcgctgagcagttg

SEQ ID NO: 65422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagcacgtgttgttacaagcccttccgtag

SEQ ID NO: 65423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagcagcgagccggcaagccccgaagatgc

SEQ ID NO: 65424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagccaggcagagagcataggactactgtt

SEQ ID NO: 65425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagccccgttatgttcgccggttacctatg

SEQ ID NO: 65426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagcccctggtatattgactcgacacaata

SEQ ID NO: 65427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagcccgaaagctggatgtactactttttt

SEQ ID NO: 65428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagccctcgcgccagtcatactgttttatc

SEQ ID NO: 65429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagccgcttaagacagtctaagtgcagagg

SEQ ID NO: 65430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagccggaggcttttgctagcaatgtttgg

SEQ ID NO: 65431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagcggcgctggggacttgctcgttaccgg

SEQ ID NO: 65432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagcggttcgtggtgtcattgggtgtccgg

SEQ ID NO: 65433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagcgtacacttgtcgtgaaagtgcgcccg

SEQ ID NO: 65434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagcgtacccctgaaatcgttctaggccgt

SEQ ID NO: 65435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagcgtgtaccttgcctaataccagactgc

SEQ ID NO: 65436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagctcattgattgggcccggttaggcgag

SEQ ID NO: 65437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagctctcttagatcacgcgtcgcactgct

SEQ ID NO: 65438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagctgaacggaatgagctttgtataattt

SEQ ID NO: 65439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagctttcgaggtcaaaggcagcacgtcgc

SEQ ID NO: 65440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggacacggaccgcatcatttaaagccct

SEQ ID NO: 65441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggattactagggcagttatgttgtggca

SEQ ID NO: 65442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggcatcaggtttacattggtcggcggtt

SEQ ID NO: 65443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggcgaagaggccaatcagcgctgtaccg

SEQ ID NO: 65444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggctcctcgcgcggattttcgctgattg

SEQ ID NO: 65445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggctcgctctttaattgttacttattta

SEQ ID NO: 65446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagggatgtctgtggtatttctgaagctat

SEQ ID NO: 65447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggggttgagaggacaacaagcggttggg

SEQ ID NO: 65448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggtacacgtcgtacatctgcgtgctttt

SEQ ID NO: 65449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggtactgttccgtgatccgggcatcatt

SEQ ID NO: 65450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggtcctttgctgggcagccgtacaagcc

SEQ ID NO: 65451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggtgatccagtgggtttcacgagttctg

SEQ ID NO: 65452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggtgatccgatccggtgttgtagcctgc

SEQ ID NO: 65453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggtgcgcaacaatttatcacgttctatt

SEQ ID NO: 65454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctaggtgcttagtacccaagacgatttggtg

SEQ ID NO: 65455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtaacgagccgacttgatcaggtgcttg

SEQ ID NO: 65456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtacactggagccaggagaggtctgcct

SEQ ID NO: 65457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtactatctcatttcgtgctgggatcgt

SEQ ID NO: 65458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtaggcgaccgaggcggctgagggtccg

SEQ ID NO: 65459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtagttgacagcctttcacatcgggacc

SEQ ID NO: 65460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtcggtcactgtggggtcacttccgttg

SEQ ID NO: 65461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtgcagcaaccgtacccctctcatccgg

SEQ ID NO: 65462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtgccaatggggtaatttgttgtgggac

SEQ ID NO: 65463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtgccctcactcaccgagcatgtctgtt

SEQ ID NO: 65464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtggagggctgacgaaagcctgaatctg

SEQ ID NO: 65465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtggtgcgtgcaaggtcccagcgttgtt

SEQ ID NO: 65466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagttgacctatcaaacctcatagttctta

SEQ ID NO: 65467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctagtttcggctctgatcttggacggttgga

SEQ ID NO: 65468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctataactgcatttaacttcaactgccatct

SEQ ID NO: 65469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatacaggaagtgcagaatcgcttattaac

SEQ ID NO: 65470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatacggatcacgttgtctcgtaggttaaa

SEQ ID NO: 65471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctataggcagatttagaggtgtgggtatctt

SEQ ID NO: 65472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatataagagctagggctaattgatggttc

SEQ ID NO: 65473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatatccgtggactgtttattttgaaatgg

SEQ ID NO: 65474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatcaccgtgcccgtggtcggtaccggttt

SEQ ID NO: 65475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatccagatgacaacccagccacatgcaaa

SEQ ID NO: 65476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatcccagccgcaaggcttatagagcgtta

SEQ ID NO: 65477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatccgccgggtttgctacgctccgtcttg

SEQ ID NO: 65478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatccgttcgcttatgctgagggcacaatg

SEQ ID NO: 65479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatcgtcccgcagaacgatcgtgttagacg

SEQ ID NO: 65480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatcgtggttccaggcttggtgcattctgt

SEQ ID NO: 65481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatctaatggacgtttgacaataagcggcg

SEQ ID NO: 65482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatctgcactgtgtccctcctcacaagctg

SEQ ID NO: 65483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatctttccactatagtgctcttggttacc

SEQ ID NO: 65484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgacggcgggaggagtcggatgataggt

SEQ ID NO: 65485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgcccactggatagcttgaatgccggcg

SEQ ID NO: 65486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgcgatccgcaccctcgttgcagtattt

SEQ ID NO: 65487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgcgcgtgtgcaatgacttaaccccgtg

SEQ ID NO: 65488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgcgtggatcggaatcttggttgggatg

SEQ ID NO: 65489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatggctgggtaatggactcaggggggtag

SEQ ID NO: 65490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgggaagacgctgttaccctggtgactg

SEQ ID NO: 65491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgggggattaagcaatcatcctggtcct

SEQ ID NO: 65492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgtcgtgggccgatgttttaacttccta

SEQ ID NO: 65493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgtcttcagagttgcgagtggttagctt

SEQ ID NO: 65494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgtgcaccatcactgcagtagtatactg

SEQ ID NO: 65495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgtgcgggatcaatgacactagtgtccc

SEQ ID NO: 65496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgttcgcgtccaaggttcgatgtttaac

SEQ ID NO: 65497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatgttcgggcgtgcgggatcagtgatggc

SEQ ID NO: 65498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctattatatgagtgcgcgggatttgcatttt

SEQ ID NO: 65499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctattcaaccaatcgtccagattcccgtggt

SEQ ID NO: 65500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctattccggtctatcgtgatcctgctgactc

SEQ ID NO: 65501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctattctggcagcctaacgagtccaatccgg

SEQ ID NO: 65502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctattgatatgtggcgtacaagcccaagcat

SEQ ID NO: 65503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctattgattatgggcagagggcattctctgg

SEQ ID NO: 65504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctattgttaagatgagaagttggcgtgtact

SEQ ID NO: 65505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctatttaaggacgtcggaagtcatgtgtgtg

SEQ ID NO: 65506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaaaaataacatgcggcgtacgtacggat

SEQ ID NO: 65507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaaagcacggtgtcatagggtgcgttgtg

SEQ ID NO: 65508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaaaggcgaggcgttagcaggtgtatgag

SEQ ID NO: 65509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaaagggccacggagatatgttccagatt

SEQ ID NO: 65510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaaatatcaaatgaaatgatctgctggct

SEQ ID NO: 65511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaacggcagatcggcaactgctttgtcac

SEQ ID NO: 65512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaacgtcacggcggatgttatggcccaat

SEQ ID NO: 65513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaacgtccccttatcaccacttcggcctc

SEQ ID NO: 65514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaactgcatgctccttctgcgaatcacct

SEQ ID NO: 65515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaacttgtgaagcatcgcagaagattgag

SEQ ID NO: 65516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaaggacgcgagtgggccggcatcgattc

SEQ ID NO: 65517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaagggcgggcttgaataccttgctatgg

SEQ ID NO: 65518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaagtggcgggtaccgtatccgagtccgc

SEQ ID NO: 65519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaatcatcatccgctaaatatttgaattc

SEQ ID NO: 65520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcaattatttaggtccggtataaattgccc

SEQ ID NO: 65521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcacctgtcatcctaaaataggcctgagta

SEQ ID NO: 65522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcacgactagaggactggaaactcaaactt

SEQ ID NO: 65523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcacgatgattttgcaagatacttggatgt

SEQ ID NO: 65524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcacgctttcgttcgaataccgtccaggcc

SEQ ID NO: 65525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcacggacggttattacaatgtgtggtgtt

SEQ ID NO: 65526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcacgggcatggatctagtcgtgttgcgaa

SEQ ID NO: 65527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcacgtgtaggacatcgggtgcatgtgcct

SEQ ID NO: 65528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcacgttacgtggtacttgtttgttggggc

SEQ ID NO: 65529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcactgagctcgatatgcatgttatatggg

SEQ ID NO: 65530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcactgtcaccgccacaacttactcacgcg

SEQ ID NO: 65531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcactttcagtcggacttaaaacccattta

SEQ ID NO: 65532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcacttttagtcagggttttgattgatggg

SEQ ID NO: 65533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagaccccgtgactcatggggctaaatgg

SEQ ID NO: 65534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagcaaacgggtcaggaggggtggtggtc

SEQ ID NO: 65535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagcctgcgattgattggcgtgcgtggag

SEQ ID NO: 65536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagcgtaagatctcaatgtgctgcgcgcg

SEQ ID NO: 65537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagctaaaaacctgccggggagcgctact

SEQ ID NO: 65538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagcttgcacgcttgcttacgtgttcgaa

SEQ ID NO: 65539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagtcaccgggtctcgccctttcatggtc

SEQ ID NO: 65540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcagtctgcgtctggctgtccgttgggctt

SEQ ID NO: 65541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcataggtcgtcggtgcaaggaggtagagc

SEQ ID NO: 65542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatatcgccgtggttgtttctaggcatgc

SEQ ID NO: 65543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatcgactgcttgtggttttttaggggcg

SEQ ID NO: 65544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatcgattaggcctggcaccgatgtcgcg

SEQ ID NO: 65545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatcggtcgtaaggcagtctcgtgttgct

SEQ ID NO: 65546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatcgtcggtacagcctcttgacgtccgc

SEQ ID NO: 65547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatctggcatcgcgctcatttttgcactc

SEQ ID NO: 65548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatgactaggataagcgatcggcctctgg

SEQ ID NO: 65549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatgagtgttcttggggattgttctcatt

SEQ ID NO: 65550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcatgggctcttaggatgactgtattacgc

SEQ ID NO: 65551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcattcatcacggctcagttattttcggtc

SEQ ID NO: 65552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcattctaataattggccacacttcgaacg

SEQ ID NO: 65553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcattggcccggatagaatcgcgatctcca

SEQ ID NO: 65554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcattgtttttcaaatttaatccggagttg

SEQ ID NO: 65555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcattttgcggtgggtcttgacacttatgg

SEQ ID NO: 65556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccaaactattatcaggtgtccttccgtaa

SEQ ID NO: 65557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccaaatatgccaaggttactttgataggt

SEQ ID NO: 65558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccaagggcggggcaatccagagccagatg

SEQ ID NO: 65559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccaataggttcgaatagtgattatggtac

SEQ ID NO: 65560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccacacgctccgaacacaatgaaagaacg

SEQ ID NO: 65561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccacccaacccagccagtaaggcagaccg

SEQ ID NO: 65562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccacgactgtctagggcgagtgagtggtt

SEQ ID NO: 65563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccacggacattattcgttcagttgcagta

SEQ ID NO: 65564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccacggccgcgaaaaagtgctttttgctc

SEQ ID NO: 65565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccaggcgaggtgaaccgtaatagttttgg

SEQ ID NO: 65566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccatcggaagtggcgtgttcgtcgagggg

SEQ ID NO: 65567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccatctaccgcaaatgttcgagcgggcgt

SEQ ID NO: 65568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccatgaggactattacatgcactcgacgg

SEQ ID NO: 65569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccatgcagcaattagatagcctgcgcaca

SEQ ID NO: 65570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccatggaccaggacccgcctggccaacta

SEQ ID NO: 65571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccatgtaatttctgatcttagcgtaatgt

SEQ ID NO: 65572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccccaatcaggtatttttgcccgaagggg

SEQ ID NO: 65573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccccaggtgtcagtcctgctcgtctggt

SEQ ID NO: 65574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccccggtttggcttgagaatcatgcgtgt

SEQ ID NO: 65575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccccgtcactggccgtcgtggttgtgtgg

SEQ ID NO: 65576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccctgcttcccgaatgaatttatgtcgc

SEQ ID NO: 65577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccgactagtaggttactccaaaatacct

SEQ ID NO: 65578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccgattatgctgactggcttagacatag

SEQ ID NO: 65579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccgctgtaactgtaaactggttcgtcaa

SEQ ID NO: 65580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccggaggatctcagcccactcaccgcta

SEQ ID NO: 65581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccggcccgggcattacctccgcagatgg

SEQ ID NO: 65582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccgggagggcggttggcgacggttactg

SEQ ID NO: 65583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccgggcggtgcggtgaaggccattccga

SEQ ID NO: 65584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccgtcccagtccgatgaaccctggccga

SEQ ID NO: 65585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccctaatatcgcgaaaaccaatccgatac

SEQ ID NO: 65586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccctatgcactttgggccaggtttgttag

SEQ ID NO: 65587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccctgcaaaaaccgcgttgcacgtttata

SEQ ID NO: 65588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcccttcgatcacgggccttcgtcttatgc

SEQ ID NO: 65589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgaggatctgcacaacaggacgtatcgt

SEQ ID NO: 65590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgagttggctgtgcttcctaaggttgtt

SEQ ID NO: 65591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgcacctattagacagtatgtgttggca

SEQ ID NO: 65592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgcctcggtacacaataaggtgatggag

SEQ ID NO: 65593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccggataagatttgtaccccacgccttgt

SEQ ID NO: 65594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccggcattgtaccgtagtcaccgccttct

SEQ ID NO: 65595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccggctactttctgtgggttagtctgatt

SEQ ID NO: 65596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgggctccacacattgattgcgctggcg

SEQ ID NO: 65597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccggtcctaggtacgagcttaccacctat

SEQ ID NO: 65598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgtatagggcgcgaaaggaatactgcca

SEQ ID NO: 65599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgtcggaagatcagtctttggtttggtg

SEQ ID NO: 65600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgtcgggcgctcacaaactactgtgcgg

SEQ ID NO: 65601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccgtggctctacatccgggcccgtattgg

SEQ ID NO: 65602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcctaactaagctatggtaagtcttgggcg

SEQ ID NO: 65603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcctaactgctattatgccataatgcacaa

SEQ ID NO: 65604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcctacgcaccagaaaaggtgagcgtttcg

SEQ ID NO: 65605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcctcagcgacttgctatcaggtttgttgc

SEQ ID NO: 65606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcctctgctctcgctgaaaccctgcagacc

SEQ ID NO: 65607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcctgctcgacatacgacctgtcacggttc

SEQ ID NO: 65608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccttgctctctaggaatattgtttgtggg

SEQ ID NO: 65609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctccttggttgccgtgtattcgatgaccaac

SEQ ID NO: 65610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgaaacaatacaattgataagcggaccac

SEQ ID NO: 65611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgaacgcatacttgatgtatgcctgcctt

SEQ ID NO: 65612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgaacgtactgcacttggttgtgacatat

SEQ ID NO: 65613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgaacgtccactccactcgaatggacgcc

SEQ ID NO: 65614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgaagctatagtgcaaacaatcgtatgct

SEQ ID NO: 65615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgaatatggtccagaagaccgggttggca

SEQ ID NO: 65616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgacaaacgcgcgaatggactcggtggct

SEQ ID NO: 65617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgacaacaggctatcaccgcgtgtggatg

SEQ ID NO: 65618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgacagacagatccttcggtataagttca

SEQ ID NO: 65619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgacccgtacttgaagaggatcggtgctg

SEQ ID NO: 65620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgacgaaagtatcaagagctcgcgttgag

SEQ ID NO: 65621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgaggagttgggaactgggccgcagtttg

SEQ ID NO: 65622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgaggattgaattgtgtgattcccatgcc

SEQ ID NO: 65623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgagtcgggcggagttgaatgctgctggc

SEQ ID NO: 65624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgagtttgcgcgggtataacggtattgct

SEQ ID NO: 65625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgatactcggaatacctgatccgtagatt

SEQ ID NO: 65626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgatatatgccacgttaggctcccacgca

SEQ ID NO: 65627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgatcagacgctcacgtggttatctgagg

SEQ ID NO: 65628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgatttgctagagatgatcattcgataga

SEQ ID NO: 65629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcaactcgcgcctgtgatgtcaattttc

SEQ ID NO: 65630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcaaggttagggactccgttgattgggc

SEQ ID NO: 65631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcatcagtttgacgggcgttcggtccaa

SEQ ID NO: 65632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcatgtgccttatttgcacgagctgtct

SEQ ID NO: 65633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcatgttcgtggcccggcacccttgatg

SEQ ID NO: 65634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgccaaatccgagtttgcgattcaaggtt

SEQ ID NO: 65635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgccaatgcggagcgtggttgcatgttcg

SEQ ID NO: 65636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgccactcggttgtgatcgcgcgtgtgcg

SEQ ID NO: 65637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcctaataaatgtctcttcccacagtcc

SEQ ID NO: 65638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcctactcatataggatagacttgtatg

SEQ ID NO: 65639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcgaggctcctcagttggtccctgtttt

SEQ ID NO: 65640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcgatgcttgtgtcactcagacatcgtc

SEQ ID NO: 65641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcgccaccgggatttatgagctcacatc

SEQ ID NO: 65642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcgctaattgaaccgaaagctgaccata

SEQ ID NO: 65643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcggaccgcatgacttctttctgggcgg

SEQ ID NO: 65644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcgggaatattgcgattttactagcagc

SEQ ID NO: 65645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgcgttagcggcgcagtagatcgtcgggg

SEQ ID NO: 65646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgctaacttgcatgtccagtggcttaggc

SEQ ID NO: 65647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgctaataccggtttgaatcaacttgtca

SEQ ID NO: 65648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgctagtccctctcgcacgtggcatatca

SEQ ID NO: 65649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgctagttcgccttaatagtgctgcgatt

SEQ ID NO: 65650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgctattccaataaatttgccgttgttta

SEQ ID NO: 65651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgctctccctgtgcgtgttttgtatttct

SEQ ID NO: 65652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgctctgccatgtaggttcgatggggtcc

SEQ ID NO: 65653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgctctttcatgggcatcacagttctatt

SEQ ID NO: 65654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgctgatgtttaacctggcgatatcttgc

SEQ ID NO: 65655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgctgcggacttttcaacgcccgatttcc

SEQ ID NO: 65656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggaactccacatcttgcctcacgggttt

SEQ ID NO: 65657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggaccgtcaattaccgccttctcgcgtg

SEQ ID NO: 65658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggagctcttactatggtgggatagggct

SEQ ID NO: 65659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggaggcatttcagtgagcgccaggggct

SEQ ID NO: 65660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggatacacgcgactactagtttcatgcc

SEQ ID NO: 65661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggccctcgattgcacacagtcagtaggc

SEQ ID NO: 65662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggcctatgactagatgggcttggtattg

SEQ ID NO: 65663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggctcattgttcatggttaggggaatag

SEQ ID NO: 65664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgggcaaggattcttcgtcggcgtggcgg

SEQ ID NO: 65665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgggcgtgttgacgtgtccgcacggggtg

SEQ ID NO: 65666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggggcgagcaggctgtcttgattgcgtc

SEQ ID NO: 65667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgggggggtgctttcttgtgcaagcactg

SEQ ID NO: 65668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgggtggccgtatggtgccaaccaggaag

SEQ ID NO: 65669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggtaacagcttgggtgtccttcaatagt

SEQ ID NO: 65670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggtgaatgtcgcaccggcaacgcctcgt

SEQ ID NO: 65671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggtgacggttagcggtatagtccgatca

SEQ ID NO: 65672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggtgctcagttttttgaccctggactgc

SEQ ID NO: 65673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggtgggtggaaagtcatggcgtgccggg

SEQ ID NO: 65674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcggtggtacccatttgcgtcgctcctcga

SEQ ID NO: 65675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtcccagatggccaaatcaaatgtaatg

SEQ ID NO: 65676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtcgttccgtcaatacccaagcgcttcc

SEQ ID NO: 65677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtctccgctgctccccaaccgctgttca

SEQ ID NO: 65678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtgaatcggctactgtgcttagtcccgt

SEQ ID NO: 65679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtgcaacgattaactccactgttgtcgc

SEQ ID NO: 65680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtgcccgattgtcctcttggccttccgt

SEQ ID NO: 65681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtgcggcgctcatgcttaaatccttcat

SEQ ID NO: 65682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtggtacaataagatgtgcatggtatct

SEQ ID NO: 65683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtgtggggattgatcgcttccgtcgaaa

SEQ ID NO: 65684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgttcggatgtgcatgcgtatggcactgg

SEQ ID NO: 65685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgttgcatggctttacacgaatcacggca

SEQ ID NO: 65686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgttgtactggcgctcaaccttattattc

SEQ ID NO: 65687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtttaagggaatgcagccgtggggggtg

SEQ ID NO: 65688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtttccgtataaccagtgattgttgagt

SEQ ID NO: 65689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgttttcggtgatactgaaattgctggtt

SEQ ID NO: 65690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgttttgtgtggctaacatttatctagtt

SEQ ID NO: 65691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcgtttttggtgcatagctatatccaagga

SEQ ID NO: 65692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctaatcgggtgattccccatgacttatat

SEQ ID NO: 65693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctaattcaccttgtggtgggaatagcgag

SEQ ID NO: 65694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctacacagacagaataggagattccgatc

SEQ ID NO: 65695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctacactagccctgtttcttcgataaaga

SEQ ID NO: 65696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctacgcgcctagggccaggcagctacgcg

SEQ ID NO: 65697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctactctatcggatcccgtcgcagccgtg

SEQ ID NO: 65698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctactgctagcactgaccgcctgtcagca

SEQ ID NO: 65699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctactggttgttccgttaaacggtggccc

SEQ ID NO: 65700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctacttggcggcaattacatcccagggtg

SEQ ID NO: 65701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctagcgaaacacagtgacagagtatgtgg

SEQ ID NO: 65702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctagctagcgtaattacgggctgcctcca

SEQ ID NO: 65703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctagctgacgcaatctggtggcgcacggt

SEQ ID NO: 65704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctagctgggctcagtgcgattagttcaca

SEQ ID NO: 65705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctagctgtaatgagacaggcctttggtgc

SEQ ID NO: 65706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctaggtggctgtcgcattagataagcagg

SEQ ID NO: 65707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctagtggtcagatgagcgcatcctttgat

SEQ ID NO: 65708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcaataatgctccctcgcgaaaatgttt

SEQ ID NO: 65709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctccgcttgttttttctttcaggagatcc

SEQ ID NO: 65710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctccgtatgcacgatggttatgttctacg

SEQ ID NO: 65711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcctccaacggctggggatattcaaggt

SEQ ID NO: 65712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcctcgtggtactttctctgcctgtcta

SEQ ID NO: 65713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctccttcgcgacaatgcgttatagcccca

SEQ ID NO: 65714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcgattgccttgtgccaaaccttttgcc

SEQ ID NO: 65715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcgctggatattctttttcccaatcgcc

SEQ ID NO: 65716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcggcgcggccctttaaatatcgatttg

SEQ ID NO: 65717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcggtggtgcggtggtttgtaatgttta

SEQ ID NO: 65718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcgtcgcgaagcgtgggctactaggggc

SEQ ID NO: 65719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcgtgtagcatctcaatctctaacggca

SEQ ID NO: 65720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctcttgattagacttcgcgagtgctagca

SEQ ID NO: 65721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgagttatgggtgtgcggccgggggtac

SEQ ID NO: 65722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgcacgacaacctaagtttgtgtaataa

SEQ ID NO: 65723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgcgggagacgactgaatgggcttcttg

SEQ ID NO: 65724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctggggtataccaatcggcgacgattgag

SEQ ID NO: 65725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgggtctcgcgacagcagtaatccttga

SEQ ID NO: 65726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctggtctacgtcgcaagtctggctgggtc

SEQ ID NO: 65727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgtacacaattgggtagcaatcccgtcg

SEQ ID NO: 65728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctgtggtttgatggctcgcacgattgaga

SEQ ID NO: 65729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttaactcaacattaggcgctcatgattg

SEQ ID NO: 65730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttagttacttctcggttgttgaggatgt

SEQ ID NO: 65731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttatttggtctctggttcatgcgttttt

SEQ ID NO: 65732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttcatgaatttccgaaaacgactttatg

SEQ ID NO: 65733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttccgaaactttggggatagcaacccgc

SEQ ID NO: 65734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttccttgtttccccaggacctgagttcc

SEQ ID NO: 65735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttcgtgtctctgcctctcacccccactc

SEQ ID NO: 65736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttctagatctcgagcgtggttatcctcg

SEQ ID NO: 65737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttctaggcttctataaacacgcaacgtt

SEQ ID NO: 65738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttgaaagggggtacacagtgtcgggaac

SEQ ID NO: 65739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttgtacgtgcctcgccttctgcctattg

SEQ ID NO: 65740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttgtcaggctacctggtaccacagcttc

SEQ ID NO: 65741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttgtccgaccatgcctcccatatgtggt

SEQ ID NO: 65742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctcttgtccggggctaaccgggactatcact

SEQ ID NO: 65743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctttcgatcacgttccacccgctggaggt

SEQ ID NO: 65744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctctttgtagggttgtggccatgaccgatca

SEQ ID NO: 65745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaacaaggtttccgctgatggtgcttcct

SEQ ID NO: 65746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaacgaatgctattgcgtctcgtcgcgct

SEQ ID NO: 65747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaacgagcaccggagccacctttccagcg

SEQ ID NO: 65748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaacttggcgagggtctagcttttcggtg

SEQ ID NO: 65749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaagaatggacacccctggactcgggccc

SEQ ID NO: 65750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaaggactcaaagggagatccggatagaa

SEQ ID NO: 65751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaatatcatgaacgaccgcaatggtcaag

SEQ ID NO: 65752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaatcattatgcatatacagtgagccacc

SEQ ID NO: 65753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaatgtactaggcacaaacggtcgcgctg

SEQ ID NO: 65754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaccactggggcctgagcgctgaggcaaa

SEQ ID NO: 65755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaccgttcttgcatattacaccggggaag

SEQ ID NO: 65756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgacctcaagatcacccactcggcagtgcg

SEQ ID NO: 65757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaccttttcgaatgggtgtctaaatcgcg

SEQ ID NO: 65758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgacgaagtacgaactgaacgcagtcaaat

SEQ ID NO: 65759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgacgaatcgtatatcgccgtgttggggct

SEQ ID NO: 65760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgacgaggatgcaggtgagacgcagggatc

SEQ ID NO: 65761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgacgcacggtcttgttcttgttaacccgg

SEQ ID NO: 65762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgacgcgctcgagccttacagagtgttcgt

SEQ ID NO: 65763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgacggtccccgtgttcttggagatagacc

SEQ ID NO: 65764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgactagctctcgtgatgagcaaatatgcg

SEQ ID NO: 65765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgactcgtcggtgcaaccggtgcgtccttg

SEQ ID NO: 65766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgactttcgatcctatttcatggtatcgat

SEQ ID NO: 65767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgactttgagagggttcgagccgtgttgat

SEQ ID NO: 65768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagccgcagggctaccgagccatggtgcg

SEQ ID NO: 65769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagcggacagatattcacccgcggtgcga

SEQ ID NO: 65770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagctgggatgtcacgctcatgaagcaca

SEQ ID NO: 65771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaggaaaacctttgttcaacggcgtttgt

SEQ ID NO: 65772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaggagggtgtgtgcggggtgtgtgtagg

SEQ ID NO: 65773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaggcaaatgtaaccaagatcgagggcta

SEQ ID NO: 65774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagggagtcacgctcaaatattgcgactg

SEQ ID NO: 65775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgaggtgtgacgatcgaggctcggggcaga

SEQ ID NO: 65776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagtaccttacattatccccaagcaggca

SEQ ID NO: 65777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagtccaataggctgatgatgtgacaacg

SEQ ID NO: 65778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgagtggttaggagcatggtgtagctgatt

SEQ ID NO: 65779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgataacgtgacatgacgtcaggctcatga

SEQ ID NO: 65780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgatagtacaggtctcaggaggtcagccat

SEQ ID NO: 65781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgatatgcgcgccgtattctctatacgcaa

SEQ ID NO: 65782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgatccagcgcagcctttccatctcacgct

SEQ ID NO: 65783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgatctactagccggcatgttcagttgttt

SEQ ID NO: 65784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgatgagacgaccgtgcccgttctgcacgg

SEQ ID NO: 65785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgatgtcaacattttcggcatatgcgatgg

SEQ ID NO: 65786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgatgtgagattgagctctggctaaagccg

SEQ ID NO: 65787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgattaaaagcttcgcgagccggtccgtcg

SEQ ID NO: 65788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgattctgccgctaaccaccgaagacgtag

SEQ ID NO: 65789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgattctgtcttgattccctgctgttgttg

SEQ ID NO: 65790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgattgcattcctgttctatttgaagttgg

SEQ ID NO: 65791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgattgtacggcatgtcaacgcgcgactga

SEQ ID NO: 65792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgattgtacggctcccttagatgaacctcc

SEQ ID NO: 65793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaaagcccgatggtccgaagcggaacgt

SEQ ID NO: 65794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaacatctctgcagccatttcacttttc

SEQ ID NO: 65795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaacctggcgaacaatgttcagagggtg

SEQ ID NO: 65796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaaggagtcttaggtgatgttgcggcac

SEQ ID NO: 65797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcacaacaccgtcaagtggacgccgtgtc

SEQ ID NO: 65798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaccgacgatcgtatttatggtgtcatg

SEQ ID NO: 65799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaccggagtggcacccaacttctcgatc

SEQ ID NO: 65800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaccgttaatgacgtagcttgcggcatg

SEQ ID NO: 65801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaccttccgatcgactcatcttcgattt

SEQ ID NO: 65802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcacgctcaaggagtggagtcgtagcgaa

SEQ ID NO: 65803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcacggagcgaaaggctgtcggatgaggt

SEQ ID NO: 65804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcacgtagagggagtgggatcccgcagcc

SEQ ID NO: 65805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcactctatgggtttgactccacggggct

SEQ ID NO: 65806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcacttgtgtagcattcttcaaaggaccc

SEQ ID NO: 65807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcagacacgctgctcccttaacggtagtg

SEQ ID NO: 65808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcagaggaaacggggtagttagcgttttt

SEQ ID NO: 65809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcagcaggcatcgaaccacgtgcttatga

SEQ ID NO: 65810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaggagggtcgtttatagggatagcggc

SEQ ID NO: 65811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaggctgggcggtgtggattgcggagtg

SEQ ID NO: 65812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcagggccgtaggttgatttacgttactt

SEQ ID NO: 65813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcaggggtttctcgtggggtcgtactcgt

SEQ ID NO: 65814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcatatcccgtttcccccttggtgtgtag

SEQ ID NO: 65815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcatcaatctatcgcgttatgtcgtggcg

SEQ ID NO: 65816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcatgggtccaatattagctcgttgccga

SEQ ID NO: 65817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcatttataagtgagaaatagcacctccg

SEQ ID NO: 65818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcatttcgttcgttccctctcacgagctt

SEQ ID NO: 65819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccaacacgctcgctccgttatggtccgg

SEQ ID NO: 65820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccacccaaactacatcggcgttttgttc

SEQ ID NO: 65821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccagcacagctgagtgttttgctccaat

SEQ ID NO: 65822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccagcggtgcccggtcgtgcgtgatgtt

SEQ ID NO: 65823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcccacgatgctaagtggggtgtagcatg

SEQ ID NO: 65824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcccgccaccggcgagcgatcgcgtcaaa

SEQ ID NO: 65825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcccgttataccccgcaccggaggcatac

SEQ ID NO: 65826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcccttccctgctcgatatgcgtggttta

SEQ ID NO: 65827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccgaacgggatatggattgttgcaggcc

SEQ ID NO: 65828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccgagccgttccgaactgtgctggcata

SEQ ID NO: 65829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccgcgctcccttagatcacccacatctg

SEQ ID NO: 65830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccggagcgctcacttgcgtcggtactgc

SEQ ID NO: 65831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccggggtgggagtgtaataggggggggc

SEQ ID NO: 65832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgccgtatgcggcaaatcgcttcaccccgg

SEQ ID NO: 65833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcctagttgttccctgttaactttatgct

SEQ ID NO: 65834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcctccgggttcttgaatacgttgggcct

SEQ ID NO: 65835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcctcgcaattcaaaggtccttaagtttg

SEQ ID NO: 65836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcctcgtcgccggacgtacgtggtcgggg

SEQ ID NO: 65837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcctggtgaatgctgcctgttcagcgatt

SEQ ID NO: 65838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgaagacgtagtgcgcatgattgctgtg

SEQ ID NO: 65839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgagatgattggtggtaggaccagatgg

SEQ ID NO: 65840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgaggcgtcgcggtttcacgatcacctt

SEQ ID NO: 65841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgcctcacatatatctggccaggcgtgt

SEQ ID NO: 65842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgcggttcgtagcgatcgagcggtagcg

SEQ ID NO: 65843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgctgctccatacgtaactgtcggctag

SEQ ID NO: 65844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgctgtcgggctctggattctcgcttcg

SEQ ID NO: 65845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcggcgcggcggaaccacactggtctgtg

SEQ ID NO: 65846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgggaaacttgagtatggcaggatggat

SEQ ID NO: 65847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgggatggagtctagagccggcgtgcaa

SEQ ID NO: 65848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcggggagccgggactggtatgtaactgc

SEQ ID NO: 65849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgggggggctccgaaacggacttctttg

SEQ ID NO: 65850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgggggtagcacataaacgctgcattct

SEQ ID NO: 65851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgtaagcaatgcggtccatctgcctcat

SEQ ID NO: 65852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgtagcgggcgatttctggctttcgggg

SEQ ID NO: 65853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgtctccgggtctcatgactcatcctcg

SEQ ID NO: 65854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgtgtagttcgtttggcacccttaattc

SEQ ID NO: 65855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcgtttggatcagatgtatgctgggcgcg

SEQ ID NO: 65856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctaagacttcatggcgtggtaccctact

SEQ ID NO: 65857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctactcttggcaactccaaatctgggtt

SEQ ID NO: 65858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctcgtacgtccccgagttctccagcgcc

SEQ ID NO: 65859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctctaaaaaggggttcatttgagcatcg

SEQ ID NO: 65860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctctaattctgtgccctgtcatctagcg

SEQ ID NO: 65861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctctaggacacagtttcgttcggcctcc

SEQ ID NO: 65862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctgagcaagcagtggatacctcaactta

SEQ ID NO: 65863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctgaggaatcgcatcaagtgtcagcttc

SEQ ID NO: 65864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctgagggcttagcgttgattccgcctcc

SEQ ID NO: 65865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctgcatcgcctttccggtaaaatttcgc

SEQ ID NO: 65866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctgccttttgctggatctcggatacccc

SEQ ID NO: 65867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctgcgacgttgacgtcatgcccactaca

SEQ ID NO: 65868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctgcggtattctacgattggcgggcccg

SEQ ID NO: 65869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctgttcttaatgtccatatggcgtgctg

SEQ ID NO: 65870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcttagactgtagtctgccaattgtaacg

SEQ ID NO: 65871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcttcccccaactcgcgcgggcaagacga

SEQ ID NO: 65872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcttcccgtcttgtgtaagtattgcttga

SEQ ID NO: 65873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcttcggcacggacagagtcaccttactt

SEQ ID NO: 65874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgcttcgtcccgatatacggcgtgcatttt

SEQ ID NO: 65875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgctttcaagttgaaagggtcgacattagc

SEQ ID NO: 65876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggaacggagtcgtactggggagccgagcc

SEQ ID NO: 65877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggaatgcactcggatgttatcttagcgcc

SEQ ID NO: 65878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggaattacgtgatgacttaggcttgtttg

SEQ ID NO: 65879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggacatgtctgacgaactgtctctcaggt

SEQ ID NO: 65880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggacgaagttcgagtgaggcaagtgtggg

SEQ ID NO: 65881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggactacgcatatggattttgttgctata

SEQ ID NO: 65882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggagctggtccgagagcatccagggccgg

SEQ ID NO: 65883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggaggcatgtatttgatcaatgcgacggg

SEQ ID NO: 65884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggagggaagctcaacgggctcttgggtac

SEQ ID NO: 65885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggatcgctcgtataatggagctcacttcg

SEQ ID NO: 65886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggattaggcattcatgtcacggtgctttg

SEQ ID NO: 65887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggattgaatgtaactgatatttaggcctg

SEQ ID NO: 65888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcaaatcgaagtcaatatctgccgaatc

SEQ ID NO: 65889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcaacataaccagggctgacacgcgcga

SEQ ID NO: 65890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcacggcggaaatctgttgctggttggc

SEQ ID NO: 65891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcagaaagcgcctggcctgatggtaacg

SEQ ID NO: 65892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcaggctataaggcagttacatatcgtg

SEQ ID NO: 65893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcatgattttttagaaacatgtcacgct

SEQ ID NO: 65894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggccagacttggtaatcacaccgggatga

SEQ ID NO: 65895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggccagcccatcaactgcggtttgaggca

SEQ ID NO: 65896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcccctaactgtagtacatgcagcacgt

SEQ ID NO: 65897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcccgccctttagtcccgaattgacctg

SEQ ID NO: 65898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggccggcccgctcatgcgcatatgtcggt

SEQ ID NO: 65899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcctttgcatgtgccaatagtatctctc

SEQ ID NO: 65900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcgcagcatctattggcccgagcccgcg

SEQ ID NO: 65901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcgtgagggaacgcactgaggcggcttc

SEQ ID NO: 65902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggctcgggtttcaaatacgattatgggcc

SEQ ID NO: 65903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggctggacatgccttgcgataccccacct

SEQ ID NO: 65904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcttcattcaactacggaatgcgcaccc

SEQ ID NO: 65905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggcttgaacacatgatgcgttcccatcga

SEQ ID NO: 65906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggacgcaacgaagaatggcagaatcacg

SEQ ID NO: 65907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggactgtaagcttttttggatctacttt

SEQ ID NO: 65908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggagaatatgatgcgattatagctgggt

SEQ ID NO: 65909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggagattccctgcagtgcgctgttgagc

SEQ ID NO: 65910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggataccgctcacggtcttttatcctat

SEQ ID NO: 65911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggatgcaactatagctgcggcgcgccgt

SEQ ID NO: 65912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggatttatatttcatcacgaagagactc

SEQ ID NO: 65913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggcacaagtaagatcgtgatctactttg

SEQ ID NO: 65914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggcagggtttattccatgttacagttta

SEQ ID NO: 65915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggcattctggatccctgctttggctcgc

SEQ ID NO: 65916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggccggttctactcaactcgatgttgtg

SEQ ID NO: 65917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggcgcgacgtccgacggtaaattttgta

SEQ ID NO: 65918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggggattgattctgtgcgtctagctgtgg

SEQ ID NO: 65919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggggcgggtttgcaacgcaaccgcaaggg

SEQ ID NO: 65920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggggagcggtaaacggtggcagccaggt

SEQ ID NO: 65921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggggcggccgaggaacggtgttcttttg

SEQ ID NO: 65922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggggcgtcttatcggagtagcaagggaa

SEQ ID NO: 65923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggggggaatgtagcgatccgtggactcgg

SEQ ID NO: 65924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggggtcgcttagccggaaagtgtaggtg

SEQ ID NO: 65925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggggtagcctcgagaagcgtggtaaacgc

SEQ ID NO: 65926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggggtgaacaccgcattgggggctgcttg

SEQ ID NO: 65927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggggtgacgaggacggtgtatgacgggtt

SEQ ID NO: 65928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggtacggtagtagctcaacgcatatctg

SEQ ID NO: 65929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggtatctggtagcctgttgttcgatttg

SEQ ID NO: 65930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggtctacttcagctgctgggcaaattga

SEQ ID NO: 65931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgggttatcctgcgaatggcgcaccggact

SEQ ID NO: 65932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtaaaaagtcctggatgttctttttatg

SEQ ID NO: 65933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtaatgacaactgcgtcatactggtaga

SEQ ID NO: 65934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtacgcaagctctatcgagggccctact

SEQ ID NO: 65935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtactccgcgtcccatcagtactctccg

SEQ ID NO: 65936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtagatacacagttgttccttggtgtga

SEQ ID NO: 65937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtagtgatctcttggatgtttcggcagg

SEQ ID NO: 65938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtccatttgatcttgttgtgcggggatg

SEQ ID NO: 65939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtcgcagggggatgtacgatgttaggcc

SEQ ID NO: 65940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtctagttagttatcctaaacgggtgag

SEQ ID NO: 65941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtgaccggacttttcggggattggcgcc

SEQ ID NO: 65942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtgtatccacagactcgtttcttatgcg

SEQ ID NO: 65943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtgtcaattacatcccagacgcggattg

SEQ ID NO: 65944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtgtgcagaactgatcatctttaggcgg

SEQ ID NO: 65945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtgtgtagccttaataggtacaggatta

SEQ ID NO: 65946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggttagccagttgcgtttgaacggagtgt

SEQ ID NO: 65947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggttgcgtgatgaggcggggctgctggct

SEQ ID NO: 65948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtttaatgtgttttcctcggttaaagat

SEQ ID NO: 65949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtttacgatggtaattgccttttgagga

SEQ ID NO: 65950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctggtttcgccatagcaccttggttgccagt

SEQ ID NO: 65951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtaaatatgcgcaggttaacacgtacgat

SEQ ID NO: 65952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtaacaaaataactactgcgtaatcatgg

SEQ ID NO: 65953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtaacaccgccaccaaatcccaggtaagc

SEQ ID NO: 65954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtaacacggagatgatggtataattgggc

SEQ ID NO: 65955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtaacagggcggaggcgagctagggtttc

SEQ ID NO: 65956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtaattaggccctattcttaccgctccac

SEQ ID NO: 65957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtacaggctgattgaaaaaataagtggcg

SEQ ID NO: 65958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtaccgtatgcgtgagcgagtaagagact

SEQ ID NO: 65959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtacgttcagtatactctgtttggcccca

SEQ ID NO: 65960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtagacgacatcaaaggtgcggttggacg

SEQ ID NO: 65961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtagattactagtgaattttctagatccg

SEQ ID NO: 65962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtagccggcctatgacggtgaaggtgcgg

SEQ ID NO: 65963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtaggccactgctgaagggcatgcaacac

SEQ ID NO: 65964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtatcggtatggtgcatgcgtgtttatgg

SEQ ID NO: 65965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcagcacccgaagttatgtgtcgcatcg

SEQ ID NO: 65966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcagcccccggagtacggatggaaccct

SEQ ID NO: 65967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcagctaaactccgggtatgtctttgtg

SEQ ID NO: 65968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcatagaccacgcggggaacctttgccc

SEQ ID NO: 65969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtccatctcacgggcagattctatatgtt

SEQ ID NO: 65970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcctccgtgcgctgacttgcaccctctt

SEQ ID NO: 65971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtccttctaaaggcgaggttatttgtagt

SEQ ID NO: 65972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcgatgctgcatcagagcgcgcgcattg

SEQ ID NO: 65973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcgcgggtggactagtgatacctaaggc

SEQ ID NO: 65974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcggatctcgtcccacccaggttcttcc

SEQ ID NO: 65975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcgggggagtttacagggggtctgatgg

SEQ ID NO: 65976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcgtgatgctctctggccttatacgagg

SEQ ID NO: 65977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtctagggcggcatcggggatgaatgcgg

SEQ ID NO: 65978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtctcgtgttgaccttaaccggctttggt

SEQ ID NO: 65979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtctggcttggtcaggggtatagatttcc

SEQ ID NO: 65980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtctggtacccatcataatgtcctggctt

SEQ ID NO: 65981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtcttcggtgcaacgcgaattgccgcgtg

SEQ ID NO: 65982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgaagatgaactgcgcgcccagtgatat

SEQ ID NO: 65983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgaatgatccagctgcagccctccctta

SEQ ID NO: 65984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgaccgttaaattggttgtgcaattgct

SEQ ID NO: 65985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgagaaatcgattatctcttcgggcaag

SEQ ID NO: 65986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgatattttgcgtgcatccgaaaaggcg

SEQ ID NO: 65987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgcattgatgcacatgggccagccgctg

SEQ ID NO: 65988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgcggttaggctgtgtggcattcaatcg

SEQ ID NO: 65989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtggagctcattttgggggacctattacc

SEQ ID NO: 65990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtggaggggtgttttggggcttctgtagg

SEQ ID NO: 65991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtggagtgctgcgcatgcgtcgtcatccc

SEQ ID NO: 65992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtggattagtaaggatctgagagaattct

SEQ ID NO: 65993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtggattcagcggtcggcttgggcgcagg

SEQ ID NO: 65994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtggcatggatctaatgtctagcgagaac

SEQ ID NO: 65995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgggtaccggcagcgtttgtgcaattct

SEQ ID NO: 65996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgggtctgtgctgggatataccaaggaa

SEQ ID NO: 65997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgtactgtatggctgcctagatgcggag

SEQ ID NO: 65998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgtccagtgcggatcagatgacgggtgt

SEQ ID NO: 65999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgtccgggcggttggtttttgtgcgttt

SEQ ID NO: 66000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgtgagagcgatacctggtgctggtgtt

SEQ ID NO: 66001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtgtgatttagtgactgtttgcagatggt

SEQ ID NO: 66002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttaacaacgtctgggggtcatttgcaat

SEQ ID NO: 66003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttacaccgcccttttctcttcttagccg

SEQ ID NO: 66004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttacgcgacagtctcaaccacccatgac

SEQ ID NO: 66005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttacggcagcgcatcactaaagggtcct

SEQ ID NO: 66006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttaggtacccggaaggatactggcatag

SEQ ID NO: 66007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttcacgtctcctggaccacccctgaggt

SEQ ID NO: 66008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttccagccatgtaccaagcgggccgacc

SEQ ID NO: 66009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttcttattcgtgcgagcctgcttatccg

SEQ ID NO: 66010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttgctttatttgcgcctgttaggtgatt

SEQ ID NO: 66011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttgggagggtcagagtgtgttttgtgcg

SEQ ID NO: 66012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgttgtcattcctgagaccggaggcatttg

SEQ ID NO: 66013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtttaacccaggggccacaattaccattt

SEQ ID NO: 66014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtttagacagggggtgtatactgcgagtt

SEQ ID NO: 66015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtttagtgtgtttcgtctcgagtttcggt

SEQ ID NO: 66016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtttgccgtgcgcaaaatggtgttcgtgg

SEQ ID NO: 66017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtttggttggccgttggtgattgtaatcg

SEQ ID NO: 66018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctgtttttatctggtaattttacacgataat

SEQ ID NO: 66019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaaaggactgcgatgaccggattcatagg

SEQ ID NO: 66020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaaaggttttatggtggctttgtaacacg

SEQ ID NO: 66021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaaatccacaatgtgaagggcgtactaag

SEQ ID NO: 66022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaacagccgaacgtggtaaagttctgaat

SEQ ID NO: 66023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaactttggggtacaaagtctgctcttgc

SEQ ID NO: 66024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaatttcgggacttataatacgtcgtatg

SEQ ID NO: 66025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttacatgtccttttcgtgtcgacgcagtgt

SEQ ID NO: 66026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaccgctcacctcctagtttcgctcctca

SEQ ID NO: 66027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttacctgcgttcactcttacgttgttagcc

SEQ ID NO: 66028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttacgcgagccgaagggaattcgctatgat

SEQ ID NO: 66029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttacgcgtcttgtgtgctcggaattgcttc

SEQ ID NO: 66030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttacgctgtatccatcctgggtaccgagcg

SEQ ID NO: 66031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttacggaaatttatgaattgttcaatcagt

SEQ ID NO: 66032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttacgtgagtcacgaccggtcggatcatgt

SEQ ID NO: 66033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttactaactcgttggatccttgtgtgtgcg

SEQ ID NO: 66034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttactaatgactcgaccacggactgcgcta

SEQ ID NO: 66035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttactacactcgggcgatgcgtggagctat

SEQ ID NO: 66036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttactagacacccttaggacgattcgtcgg

SEQ ID NO: 66037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttactggctatcggaaccctgtcagcggct

SEQ ID NO: 66038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttagagataacgatgaacgcgggttacgtt

SEQ ID NO: 66039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttagcaaaaggtgacgatcggagaggacgg

SEQ ID NO: 66040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttagcaaccagtcactagtatgaacatttt

SEQ ID NO: 66041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttagcgcatttgttatgtttgaaacgatct

SEQ ID NO: 66042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaggaagggaatggcctatgtgtggtgtg

SEQ ID NO: 66043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaggagaggggactctcacaagcgaacgg

SEQ ID NO: 66044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaggcattcgatggtttcagagacttaca

SEQ ID NO: 66045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttagggagagggccgaggcgtgttggttcg

SEQ ID NO: 66046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaggggaagttcacgctacctttcatggc

SEQ ID NO: 66047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaggggtcaaatgccagcggacacgtggc

SEQ ID NO: 66048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttaggtctgcctcgttaggtgttatttttg

SEQ ID NO: 66049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttagtcaaagcagaacccaaggtttacccc

SEQ ID NO: 66050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttagtgcacgggatgttggtcggcatcaag

SEQ ID NO: 66051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttagtgtatgttgcggatgcatactcgcgt

SEQ ID NO: 66052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatacatcaagggcaccgctctcgttggg

SEQ ID NO: 66053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatcaccctgtctcacgctacttgctgtt

SEQ ID NO: 66054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatcctgattacgggatgaacggtccgcc

SEQ ID NO: 66055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatcgacgtgggatggatgcgcggtccgg

SEQ ID NO: 66056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatcgcgttggtccgctctcgcagaacac

SEQ ID NO: 66057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatggagttaaaatgctcgagcctttggg

SEQ ID NO: 66058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatgtattataggggaaaacgaatcgggt

SEQ ID NO: 66059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttatgtggtctgtgcttttacgtttgtgtg

SEQ ID NO: 66060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttattacgagttaaggacgttcttaaaacc

SEQ ID NO: 66061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttattctttcgtgaggcggtctggctgagc

SEQ ID NO: 66062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttattgtgtccggcgagacgctaaggcgtg

SEQ ID NO: 66063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaaacgatatgccccatgggactcttgc

SEQ ID NO: 66064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaacccaaaaggggggtggtgccatgga

SEQ ID NO: 66065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaagatgtctcgggtaaggcgcggaaag

SEQ ID NO: 66066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaagcgagcaccagggcacatatctttt

SEQ ID NO: 66067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaatgcaccaccctctagcgaatttgcc

SEQ ID NO: 66068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaatgttcacttgtggtctggcggcttt

SEQ ID NO: 66069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaccttccagacttctttatcgttgtcg

SEQ ID NO: 66070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcagcacggcgtcattagctacgtttata

SEQ ID NO: 66071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcaggcggagggggtccaagtctcaaggg

SEQ ID NO: 66072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcatcacgtggaattggacaagtgcgcgc

SEQ ID NO: 66073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcatgcagtaagaaaatttcgccgatctg

SEQ ID NO: 66074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcatgctgttaaggacaggcgtttgctag

SEQ ID NO: 66075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcattgaccgaagatcgtggcgtccttct

SEQ ID NO: 66076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcattgtaatgcgatccatcgacttccct

SEQ ID NO: 66077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccacgaacgctagtaacattgtcggccg

SEQ ID NO: 66078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccaggtatgcttctacaccacaagttaa

SEQ ID NO: 66079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccagtttctcgccgttgatcgattacaa

SEQ ID NO: 66080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccatgggtccttttggcgttaggttgga

SEQ ID NO: 66081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccccagacgctccgagatcgtgtcctac

SEQ ID NO: 66082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccccgacgcccgtatcgcgccatagtgt

SEQ ID NO: 66083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcccgtacgggcgcacatacggttcgtgg

SEQ ID NO: 66084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccgtgcggtggctccactgagttgtcgg

SEQ ID NO: 66085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcctacggcctcctcgcttgctgtgtgct

SEQ ID NO: 66086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcctattctggttcagcgtctttgttacc

SEQ ID NO: 66087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcctcacgagttgactaactttcattggt

SEQ ID NO: 66088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttccttttgatccctccacgaacagaacgt

SEQ ID NO: 66089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcgaaatcacctcagtctttagccgtccg

SEQ ID NO: 66090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcgacacagaaatgcagtacctaatttgg

SEQ ID NO: 66091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcgagagacttgggacgtggtttgaagtc

SEQ ID NO: 66092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcgatgccttctccgcctgctcggtatgg

SEQ ID NO: 66093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcgatgggtgcactggtaaaccatattcg

SEQ ID NO: 66094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcgcccttataggtcttgcgtggatactc

SEQ ID NO: 66095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcgctatcatatccactacagctagcatt

SEQ ID NO: 66096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcggtaccgtgctttttgagtcacctgcg

SEQ ID NO: 66097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcggtacgggctgtccactttgggagacg

SEQ ID NO: 66098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcggtcgctttccccgcaccctcgccggt

SEQ ID NO: 66099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcgtatttcaaacacggccgctgcgcatc

SEQ ID NO: 66100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcgtcttaaggaatcatttgcccgcaggt

SEQ ID NO: 66101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcgtgatttggcgctacatcctgccttat

SEQ ID NO: 66102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcgttattatctaacaatgttgttttcga

SEQ ID NO: 66103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttctattcgagtctgaagtgaactcattac

SEQ ID NO: 66104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttctccgtacactgagtcactgcatcgtat

SEQ ID NO: 66105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttctccgttcgctaatcgtcgtgggattgt

SEQ ID NO: 66106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttctggtttcttgcattaacaggtatcagg

SEQ ID NO: 66107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttcttacggttcacaattcagcaattgtta

SEQ ID NO: 66108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgaagttgaagccatgttccgccttaggc

SEQ ID NO: 66109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgacaggcacttctggaacttttcacaga

SEQ ID NO: 66110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgagagcccagcaaataatacttcggaac

SEQ ID NO: 66111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgagcgccgtgccgtggggaatgggtgtg

SEQ ID NO: 66112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgagttatacgattgggataggcgtaaat

SEQ ID NO: 66113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgatactaagggccagttgatcttgttca

SEQ ID NO: 66114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgatagcaatcgctggcgggcgtagggaa

SEQ ID NO: 66115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgatattctgataaggcaaaggtgtatgg

SEQ ID NO: 66116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcaaatgtgatcccgttacttagggtgg

SEQ ID NO: 66117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcaatcgaaggtcgacgacggaatcggg

SEQ ID NO: 66118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcacgcgtagcccggtgccgatattgat

SEQ ID NO: 66119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcagggtcccccgcgtagtagtgtaatg

SEQ ID NO: 66120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcagtgccatcgtcttccgcgttccttt

SEQ ID NO: 66121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgccattcctgtatcttggtccttgccgg

SEQ ID NO: 66122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgccggatagttgtgcctcgggccaggtt

SEQ ID NO: 66123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcgcaccgatcaacaaacgtttcgatta

SEQ ID NO: 66124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcgcccgatccatccagtgctagtgttc

SEQ ID NO: 66125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcggacttatcaagcgcgcaacgggtag

SEQ ID NO: 66126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgcggggcatcagcgggatcactccgggc

SEQ ID NO: 66127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgctcggcatcccctaacgtcggacgcct

SEQ ID NO: 66128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgctgcaccgcttcgcgcttttactgctt

SEQ ID NO: 66129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgctgtgacctggatatcctccggattat

SEQ ID NO: 66130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggagttatcgagcgcgggtctcatcgtg

SEQ ID NO: 66131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggcacgacgacagatatcggctaggccg

SEQ ID NO: 66132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggcactcaacttcttgtctttggtctgt

SEQ ID NO: 66133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggcattaatacagatttgccaccgctcg

SEQ ID NO: 66134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggccccgctagttagtgggacacgccca

SEQ ID NO: 66135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggcggatttttagtttatctgagagttg

SEQ ID NO: 66136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggcgtgatgtacgagattcaagcggggg

SEQ ID NO: 66137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggcgtggttgtgcggcatgatcccgttt

SEQ ID NO: 66138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggctcattctacaggcgctcctatcatc

SEQ ID NO: 66139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgggcgtccactgcttcgtatatgcaatc

SEQ ID NO: 66140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgggcgttccagcggatgcccctccgctc

SEQ ID NO: 66141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgggggaggacccatgtaagccatcagcc

SEQ ID NO: 66142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggggttggcgtatggtcgatcatcccac

SEQ ID NO: 66143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgggtaccggggtgcctgggcccattgaa

SEQ ID NO: 66144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgggtgtagcgttgttaatcttaagtgtg

SEQ ID NO: 66145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgggttccacgcgctggcccatgtatgga

SEQ ID NO: 66146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgggttggaaatttatttttcggcaatgg

SEQ ID NO: 66147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggtactatcgcgccactgaaatcacctg

SEQ ID NO: 66148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggtataaagcccgacggatagtgctgga

SEQ ID NO: 66149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggtcctcggtacaccgtttcgcaggggg

SEQ ID NO: 66150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggtcttgtccatcaaatgcagaatgact

SEQ ID NO: 66151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggttacatactgaagagtggtggtggtt

SEQ ID NO: 66152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggttgcgggaccttgtccggggtggaat

SEQ ID NO: 66153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttggttgtaaaatgtgcttgctggagctcc

SEQ ID NO: 66154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtaataatacaaaaccatgatcactgtg

SEQ ID NO: 66155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtaattatctattaccttaattcctgtg

SEQ ID NO: 66156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtaggaattggtttggccccttctcctg

SEQ ID NO: 66157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtagggctctctgatttcttggtagatg

SEQ ID NO: 66158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtcgcgggccgaagcagagataatcatc

SEQ ID NO: 66159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtctatgtttgtgccattgccgtaatgt

SEQ ID NO: 66160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtgatgtcgagtcgagattgcctactgc

SEQ ID NO: 66161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtggggatcagcgctccacaaaataagt

SEQ ID NO: 66162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtgtgtgaagttcgccacgcgttttacg

SEQ ID NO: 66163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtgttccctggtattcttgtaaatagtt

SEQ ID NO: 66164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgttgagtccgtatggatgatctcaagac

SEQ ID NO: 66165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgttgtcttggcctcgattttggggtgtt

SEQ ID NO: 66166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtttacgtgatcggattgacggaatctc

SEQ ID NO: 66167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttgtttgtagtagtcttcatacgcgtcaag

SEQ ID NO: 66168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttaaaggtgataggcgctttagaggatag

SEQ ID NO: 66169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttacactcctttgaaggtgctttcgcttc

SEQ ID NO: 66170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttacggagataaattgtaagttgctatag

SEQ ID NO: 66171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttacgggcacgtattctatctgcgttgct

SEQ ID NO: 66172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttagcggtgcacctgatccactgtagaaa

SEQ ID NO: 66173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttagtgtgagcccgcgcgcgttgtgactg

SEQ ID NO: 66174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttatcccgattggtttcccttcccggctt

SEQ ID NO: 66175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcataaactatcgatctcttcgtttgta

SEQ ID NO: 66176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcatgagtatctgtctcccttgataacc

SEQ ID NO: 66177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttccattatcttgcggttgcggggacggt

SEQ ID NO: 66178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttccctatgccctctgatttcgcacgcca

SEQ ID NO: 66179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttccggcgatcctaagtccgttctgcttc

SEQ ID NO: 66180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcgctaagggtgaatgggatatgctggc

SEQ ID NO: 66181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcggaacttacccgtgtgcgccattttc

SEQ ID NO: 66182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcggcgtattttgtgattgcccaaagct

SEQ ID NO: 66183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcggtgcacagaaaccacacatgaaatg

SEQ ID NO: 66184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcgttcagtacttcatcatttggtttta

SEQ ID NO: 66185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcgttttccaaaaaggaccttctaagtt

SEQ ID NO: 66186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttctgtactggctacgctctacacttaca

SEQ ID NO: 66187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttcttgagttgtaacggaaggtacgacca

SEQ ID NO: 66188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgatcgcaatcgggaatcgccattaagt

SEQ ID NO: 66189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgattgaagagaacgtgggatacaagta

SEQ ID NO: 66190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgcaatatatggctgtttgttgctcccg

SEQ ID NO: 66191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgcacacattccgctgtctgctccgctg

SEQ ID NO: 66192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgcacgccatttggtaccgttcgaatgt

SEQ ID NO: 66193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgcaggctgctacagagtctgagcagtg

SEQ ID NO: 66194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgcccgatgtttacctggtctaacagct

SEQ ID NO: 66195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgcggagggctcacctaaactttgaggc

SEQ ID NO: 66196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgcggcttcctcgcaggaaaaacgggtg

SEQ ID NO: 66197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgcttacgggagcattggaatcgagaat

SEQ ID NO: 66198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgcttgagtatcgggtgtgtatcttcgt

SEQ ID NO: 66199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgggcgccgcatacatccgatctcttgt

SEQ ID NO: 66200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttggggggttttgctcttccgtgatagcc

SEQ ID NO: 66201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgtatccaatgtcttgtaatgtcaaagt

SEQ ID NO: 66202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgtcactttatcccgggatgctgccacg

SEQ ID NO: 66203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgtcgtaatcagtttctagagtctattg

SEQ ID NO: 66204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgtctagcatgttcgtgtagttgctggc

SEQ ID NO: 66205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgtctgatacctcgttagcatatctgta

SEQ ID NO: 66206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgtgagcatagctgtttcagtctcgtag

SEQ ID NO: 66207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgtgggtctcgaaacgagtcgagtaaga

SEQ ID NO: 66208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgttgagttagtcaatattaacactttc

SEQ ID NO: 66209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tctttgttttttgcgttggcacgccggcctag

SEQ ID NO: 66210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttaaccgcgagctctagccagttgtaat

SEQ ID NO: 66211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttagactcggggtttccgtatcaaggca

SEQ ID NO: 66212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttaggagacaaggtacgacttgcgcaat

SEQ ID NO: 66213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttcccgttaagggttagcattttttttc

SEQ ID NO: 66214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttccctgcccgcgaattgggttaatcgt

SEQ ID NO: 66215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttgagggtaatcgtcggagctggttatt

SEQ ID NO: 66216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttgcgaattactcttgtgacccctctta

SEQ ID NO: 66217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttggaatcgggaataaccccctggtctg

SEQ ID NO: 66218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tcttttggccgggggtggtactacaggggtaa

SEQ ID NO: 66219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaaaccggatccatatgcgcgggattggtt

SEQ ID NO: 66220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaaacctggaatgtatgctggttgttcaat

SEQ ID NO: 66221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaaactaaggtacgcacaagggattgtatc

SEQ ID NO: 66222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaacaacagcatgccctcggtaggtgtagg

SEQ ID NO: 66223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaacagcaggggaagtacccacgcaatgga

SEQ ID NO: 66224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaacggcggttagcgcgtttgaaacagtac

SEQ ID NO: 66225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaacgggacgggatgtagtaaaaaaggtta

SEQ ID NO: 66226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaactagccccacatcaagggcccggcacc

SEQ ID NO: 66227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaactatcctgccagaccatttgaagaggt

SEQ ID NO: 66228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaactctcccacttacgcggcccacgcttg

SEQ ID NO: 66229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaacttgcccatctgcgctgttagagtcga

SEQ ID NO: 66230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaagcacgaatgaggtgggatgaggtttgt

SEQ ID NO: 66231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaagcgcggatcgagagtgcgtggtgtcct

SEQ ID NO: 66232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaagcgtgagagaaccacttggggaacgaa

SEQ ID NO: 66233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaaggatgcccacttgggctacgttccggt

SEQ ID NO: 66234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaaggcttcacctacagaccgcgcttaggc

SEQ ID NO: 66235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaataagccggggggtgtttaaattgccaa

SEQ ID NO: 66236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatacgctgcgaagcttggtgtggttacc

SEQ ID NO: 66237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatagtccaaccccagtagtgtagatccc

SEQ ID NO: 66238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatatgcattctgggtaggtgttgacttc

SEQ ID NO: 66239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatatgtatgtaaaattcccaggtggttt

SEQ ID NO: 66240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatcggggggtctcggagagccaggtgta

SEQ ID NO: 66241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatgatgagggggttgtggcactctgtgt

SEQ ID NO: 66242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatggatcgagtgctgacgttggtatgga

SEQ ID NO: 66243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatttggattaaatcgtgcgagttatagt

SEQ ID NO: 66244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaatttggcccctggtggattctaaccccc

SEQ ID NO: 66245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacaagtattttattttgcggttttgtaac

SEQ ID NO: 66246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacaattgtactgcctgatatcacgatctg

SEQ ID NO: 66247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacacagaggaaacggaattgagtttcgcg

SEQ ID NO: 66248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacacattctcacgaccaaccgactactac

SEQ ID NO: 66249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacacattgtattggacgtgaaggcagcga

SEQ ID NO: 66250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacacgagaagtatcccgacacgcgcgtag

SEQ ID NO: 66251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacacgcccaaagctatgtctgtgtgtccg

SEQ ID NO: 66252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacacggtccgtggggcatgtaattttctt

SEQ ID NO: 66253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacagtttgacccaggttacgccgaagtgc

SEQ ID NO: 66254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacatacgggtattacgcataagggaagac

SEQ ID NO: 66255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacatagatcgcacccgtgctttagcggtc

SEQ ID NO: 66256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaccactcgatcgctttgctccaagacgca

SEQ ID NO: 66257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaccgagcgtgggccttgccgtgtaatgtg

SEQ ID NO: 66258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaccgcctatatttaggataacacatttag

SEQ ID NO: 66259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaccgtcggcttcttagagatcaacgtctc

SEQ ID NO: 66260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaccgtcttctcatgccttctggggttgtc

SEQ ID NO: 66261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaccgtgggcgtgctgaagtcagtggtatc

SEQ ID NO: 66262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaccttaccggaagtcaagggttattcctg

SEQ ID NO: 66263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacgagaagggcaacaaatcgcgtcttgtc

SEQ ID NO: 66264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacgcaagagtgcaatgggactgagtccat

SEQ ID NO: 66265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacgcaattatagccgtattcaatgagcct

SEQ ID NO: 66266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacgcacacgaatcctttcagttatagttc

SEQ ID NO: 66267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacgcaccgccttctagtagcaaatgttga

SEQ ID NO: 66268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacgccgcggacacttccccgtaccctatc

SEQ ID NO: 66269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacgcgtcatgcactagatctgtgcttgag

SEQ ID NO: 66270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacggagtaagactacctgtcctgcttctc

SEQ ID NO: 66271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacggataatttccagccagttacagtgta

SEQ ID NO: 66272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacgtaaggtccaacacttatggttactga

SEQ ID NO: 66273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaacgtggcccgcaaactcactacttgctct

SEQ ID NO: 66274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaactaaatccagtgtaagcttcggcccttt

SEQ ID NO: 66275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaactagggccaaaaggatcaattgacaatg

SEQ ID NO: 66276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaactagggttgaatcgtgtcttgaagttag

SEQ ID NO: 66277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaactgcgcatatcgccggcggtttgtagca

SEQ ID NO: 66278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaactggccttattcacccgtgccggcaaga

SEQ ID NO: 66279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaactttacagtactcatctgcccggagttc

SEQ ID NO: 66280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagaaggcgatctgcgcataatcttgggcg

SEQ ID NO: 66281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagacggaattcctgcccgtattatgcatg

SEQ ID NO: 66282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagacgtcggtcgtcacagtcaacgtacgg

SEQ ID NO: 66283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagagaagttttattctggggactcctcgg

SEQ ID NO: 66284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagagcgctccttcgccatctctgggtcgc

SEQ ID NO: 66285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagatcacttctctctagggtctaacttgg

SEQ ID NO: 66286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagattgtggctatctcggttaacttgatt

SEQ ID NO: 66287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagcaactcgccgacgtgtttctgctttcc

SEQ ID NO: 66288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagcagtattaccgagtggctacctggtgg

SEQ ID NO: 66289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagcataatcaagactcttgaatctgtctg

SEQ ID NO: 66290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagcatcatgagatcatgccgtttttctac

SEQ ID NO: 66291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagcatggctgtagtgtccgttgtgtgatt

SEQ ID NO: 66292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagccaagcccgttgtcaccaataccgcgc

SEQ ID NO: 66293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagccacgctttggagtatcaggtagaatc

SEQ ID NO: 66294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagccatggaaggaacagcagctccctctt

SEQ ID NO: 66295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagccggcgccatcgtccttcggttgtggt

SEQ ID NO: 66296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagccggtatggctattgacagtccagtgt

SEQ ID NO: 66297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagcgaggttcaaggtcgggcgggtctgtt

SEQ ID NO: 66298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagcgcaccaatgtggttttagggagaggg

SEQ ID NO: 66299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagcgcagcgcttatttgtatctgcccccg

SEQ ID NO: 66300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagcggctggtggaaccctcgttgagtgtc

SEQ ID NO: 66301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagcgttgcgtacaacagtgataggaaata

SEQ ID NO: 66302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagctagtagaattcggcctccctgacgta

SEQ ID NO: 66303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaggaaccaatgtacatcaccttatggttg

SEQ ID NO: 66304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaggacaaatgggacttttaggggggcagt

SEQ ID NO: 66305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaggagggcccgcacttaacttgttgtacg

SEQ ID NO: 66306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaggccgccgtatgtgtacaaagtgcggta

SEQ ID NO: 66307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagggctctcagtctgtagttttaggcctc

SEQ ID NO: 66308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagggggtcggtagctgcacagaagcgaag

SEQ ID NO: 66309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaggtcaaacttgggaggaaaatcgtgcgt

SEQ ID NO: 66310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaaggtgttggcaactgtcggacatctggcg

SEQ ID NO: 66311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagtatgcgcaactaacacttacatatcta

SEQ ID NO: 66312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagtgatgccataatacgcgtttttagaaa

SEQ ID NO: 66313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagtgctgctacctctttgggcgtttggca

SEQ ID NO: 66314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagtggagggtcgtagatcatcgtattggt

SEQ ID NO: 66315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagtgtcatggccttgtgttcgaatttctg

SEQ ID NO: 66316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaagttgaacacccgcataagtcgtattctg

SEQ ID NO: 66317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaataaggcaggattcgaaaacaagtgtgct

SEQ ID NO: 66318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatacgctcggtagagcatggggagggtgc

SEQ ID NO: 66319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatagcactggtacggcatgccgggaaatc

SEQ ID NO: 66320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatagctgggtggccggaaatccccggttt

SEQ ID NO: 66321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatatcgttccgctgcttccaatggggcgg

SEQ ID NO: 66322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatattcctagcttctcatattactaagcg

SEQ ID NO: 66323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatcaaactggtgcttacctttgttctggt

SEQ ID NO: 66324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatcactatgtgaatgaaatttaggcacgc

SEQ ID NO: 66325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatcagtgggacgttacgcggacgcctttg

SEQ ID NO: 66326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatcctgtccgtttcggatcatattatatg

SEQ ID NO: 66327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatcgagttacccgtaggtcggccgttgca

SEQ ID NO: 66328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatcgcagctcagctggcgctaatgggacg

SEQ ID NO: 66329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatctgccaacagttggctaatctgcgagg

SEQ ID NO: 66330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatcttcgtagacctttgattcggaacttg

SEQ ID NO: 66331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatcttggcgtcataagcacactgcctaag

SEQ ID NO: 66332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgaagggggatgcagcggggcagggcgt

SEQ ID NO: 66333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgaatagttctttgattatcttcacggt

SEQ ID NO: 66334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgcctcgtgtggaacacgctgttcatct

SEQ ID NO: 66335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgcgtatcggtatgttaattcggccctt

SEQ ID NO: 66336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgctgttccgtccgggttggaactttag

SEQ ID NO: 66337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgggatgcggatgtccgctggcaggtcc

SEQ ID NO: 66338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgggcaacgtgctgggcgcgcagccccg

SEQ ID NO: 66339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatggtcaggtcgaggatgttataagggtg

SEQ ID NO: 66340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatggttcacataggctgggagcatttatt

SEQ ID NO: 66341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgtatgaacgtctctagtgggcttcgtc

SEQ ID NO: 66342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgtgatctaaatgtttgtgggctgacct

SEQ ID NO: 66343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgtggtatcgcacagtagtcgtcactct

SEQ ID NO: 66344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgttgtctgggaatcgccggagctacat

SEQ ID NO: 66345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatgtttgcgtgatatgtaccacgatgggt

SEQ ID NO: 66346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaattaaaccgatagagggacggaggtaatt

SEQ ID NO: 66347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaattaggcctcactctttggttgatgtggt

SEQ ID NO: 66348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaattcatttcgcggcggcatctatcgtatt

SEQ ID NO: 66349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaattcccgtccgtataagtagaccaaatgc

SEQ ID NO: 66350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaattgctgggggccgcgcgaggggtccgcc

SEQ ID NO: 66351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaattgtgtgatccttctctgtctcgcgcac

SEQ ID NO: 66352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatttcctcggggccatacctcggaccgca

SEQ ID NO: 66353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaatttggtcaatgtttgaggtggttgagac

SEQ ID NO: 66354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaacatctaaggtcatgccgaattacgta

SEQ ID NO: 66355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaacattttactgaggtgagtgtttctcg

SEQ ID NO: 66356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaacgttttgttttttttgttctatgtac

SEQ ID NO: 66357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaagcgagagtggaaactccagtgggcgg

SEQ ID NO: 66358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaagctggattggctaactggccttttta

SEQ ID NO: 66359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaagggagccgacgcgtatggcgttaccg

SEQ ID NO: 66360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaatagcgtgagcggttgcgggacggtcc

SEQ ID NO: 66361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaatgaacggcaccccaggtccggcggtt

SEQ ID NO: 66362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaatgattcccgtttaggagtggttttag

SEQ ID NO: 66363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacaagttccttagggcgtagttttgtag

SEQ ID NO: 66364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacagtaccttggacgactaaaactcctt

SEQ ID NO: 66365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacatcacgtttaagcagtccccctacga

SEQ ID NO: 66366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaccccgtcgcaatctcctggaacaaact

SEQ ID NO: 66367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacctcatcacgtacaaagaccagtggtc

SEQ ID NO: 66368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaccttccatctgactcgcttaagtcgcg

SEQ ID NO: 66369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacgcaccctttgcgaagtccgcacgcac

SEQ ID NO: 66370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacgcgcggttgcttggggacgtatcacc

SEQ ID NO: 66371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacggtctcggttgggtgcgccttatcgg

SEQ ID NO: 66372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacgtgtaatcgctctcgaatcggaagtc

SEQ ID NO: 66373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacacgtgtcataggcatggatggaccatgt

SEQ ID NO: 66374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacactacatgcgacaataaccttacgtggt

SEQ ID NO: 66375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacactggtctgcaccgttcaaccccctact

SEQ ID NO: 66376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacagatggtgtcgaataacttggtatccgg

SEQ ID NO: 66377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacagcatcccgcaatctactgatgaacccg

SEQ ID NO: 66378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacagcggatgttgtttcgtcgtatgctcca

SEQ ID NO: 66379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaggagcatgcggcaaactatggctgggg

SEQ ID NO: 66380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaggattcccgatttgcgcgaacagtatc

SEQ ID NO: 66381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaggctaacatcccgattccacgcagcgc

SEQ ID NO: 66382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaggctgattcaaatgcgctcaccggcgg

SEQ ID NO: 66383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacagggctggaagggttacaagattgacta

SEQ ID NO: 66384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacaggtgtgtcgcttaaaatatcatatcgg

SEQ ID NO: 66385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacagtcccgtaagtactgttcattattgct

SEQ ID NO: 66386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacagtgtctgaattagcagcaacggtgctg

SEQ ID NO: 66387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacataataggcatattacgggcggctttgc

SEQ ID NO: 66388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacataatgaagtctgccagttgcgcgagtg

SEQ ID NO: 66389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacatagaggccgttagagttgtgctggggt

SEQ ID NO: 66390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacatccccggtatggtacaggttggcacgg

SEQ ID NO: 66391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacatctgctcgtggtaccggattcctctta

SEQ ID NO: 66392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacatgatcggcactcgtcccagcatcggta

SEQ ID NO: 66393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacattacacgagaaccgtaataagtaccga

SEQ ID NO: 66394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacattacgtcaagagcttaatccgtaaggc

SEQ ID NO: 66395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacattgggtctttcatacgggccagtagtg

SEQ ID NO: 66396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccacacttgtaacattgctcctgccacgc

SEQ ID NO: 66397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccacagcttgtatagcgagggtgcacgcg

SEQ ID NO: 66398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccaccccttatgctgtccatcgttggtta

SEQ ID NO: 66399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccacgatagcgccggacaaggttgcaccc

SEQ ID NO: 66400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccactcttccctatcaagagcagtgtttg

SEQ ID NO: 66401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccactgtggaaattgttcagctgattgtg

SEQ ID NO: 66402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccacttcttgttcattgcctctctagtat

SEQ ID NO: 66403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccagcgctgccagcgttcgtctgcagaaa

SEQ ID NO: 66404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccagcggggtccaggctgttgcgcaatca

SEQ ID NO: 66405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccaggtctcccccccaggaagtcgactcg

SEQ ID NO: 66406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccacatccacgtccttccttgcgtctcg

SEQ ID NO: 66407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccagataccggctgtgcacgcgtgcgtt

SEQ ID NO: 66408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccattgcgataatttcagcagggcgttg

SEQ ID NO: 66409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccccccgcggcgacctgggggactcgtt

SEQ ID NO: 66410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccccggcggtgttgcatacggtactgtg

SEQ ID NO: 66411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccccgtaacgatcttcacgcgtgtcatgg

SEQ ID NO: 66412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccctctcgtggcttgatgtggtttaagg

SEQ ID NO: 66413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccccttagcttgtttgggatcttggtggt

SEQ ID NO: 66414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccccttcactcgaccacgtcgaaccatca

SEQ ID NO: 66415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccggattagtcttagcattaccttccca

SEQ ID NO: 66416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacccggcttcatgacaccaccacatatcct

SEQ ID NO: 66417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccctggtaatgatgccgcactgttccacg

SEQ ID NO: 66418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccctgtccactatcaatacgatgctgtta

SEQ ID NO: 66419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgaagcatatacgttttcgttagacatg

SEQ ID NO: 66420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgatcgtcccactgcgggaagccaatct

SEQ ID NO: 66421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgatgatacgtgtagtgcccgggatgcg

SEQ ID NO: 66422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgcaggtacacaatgccgtggttcggta

SEQ ID NO: 66423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgccgaccgtaaacgcagggatcttcgt

SEQ ID NO: 66424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgcgcatgtacagggctacagcctctgg

SEQ ID NO: 66425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgcggttgcaatgtgggtgtagccggtt

SEQ ID NO: 66426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccggaccacgtagagtgctgcccgagctg

SEQ ID NO: 66427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccggagcttgggagacatatgtctgtggt

SEQ ID NO: 66428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccggataggcacgaatttagctgaatagg

SEQ ID NO: 66429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccggcgggcgaaggtacagcccgtggcta

SEQ ID NO: 66430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccggcgtgaccccccgacggcgtgattag

SEQ ID NO: 66431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccggctttcgagtcgaacggcatcgagtc

SEQ ID NO: 66432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgggaacacatagcagtgtagtgcagtg

SEQ ID NO: 66433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccggggcgtgtgtcgcgtaaaaggttcgt

SEQ ID NO: 66434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgggggatggtaaggtgtcaatcgtgga

SEQ ID NO: 66435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccggtagactgttccctaatttttggcgg

SEQ ID NO: 66436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgtgatggaccgcggttagaggcgtgta

SEQ ID NO: 66437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgtgcggggaaagtcccacgatctggac

SEQ ID NO: 66438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccgttaccacccgttgaatcggttccgtg

SEQ ID NO: 66439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacctcaaatccgtttgtttgcctgcggggt

SEQ ID NO: 66440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacctcgtgggtttgctgcagttttgatctt

SEQ ID NO: 66441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacctgataaggccatcctggcattgatcgt

SEQ ID NO: 66442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacctgatatctggttggtgtgcactaccgt

SEQ ID NO: 66443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacctggggttgatatgcagcctacgttgac

SEQ ID NO: 66444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaccttgcttgagctgtctactccactcgat

SEQ ID NO: 66445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacctttgtccgggggtatccgtcatactcc

SEQ ID NO: 66446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgaacagtgaacgggccaggctcgggtgg

SEQ ID NO: 66447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgaagccacagcgatcggtaggcgccggc

SEQ ID NO: 66448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgaagcgcggcgcgtcggcatgaacacgg

SEQ ID NO: 66449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgacatcgcgctcgtaataagattcactc

SEQ ID NO: 66450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgacccccgtatgtctgtccagtagtgta

SEQ ID NO: 66451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgaccggataggctagttgtaccactgcg

SEQ ID NO: 66452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgacctgcgggacaggcacatggtgtcga

SEQ ID NO: 66453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgactagtacaatcccaattctgttatgt

SEQ ID NO: 66454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgacttacgtgtcttgtcacatcttcatg

SEQ ID NO: 66455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgaggtatccaaacattcgggacataggg

SEQ ID NO: 66456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgagtccgtcttcctgtgattgtaaacgc

SEQ ID NO: 66457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcacagttatccgttgaatcctccctga

SEQ ID NO: 66458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcacctcgcacttgccgaaccgagacta

SEQ ID NO: 66459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcatcttaagtttgctttgactaagatc

SEQ ID NO: 66460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgccacagcccgggtggtgggtcctagcc

SEQ ID NO: 66461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgccatatgaagggttttgaagttcccct

SEQ ID NO: 66462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcccgaacgctggaagagtgtgtaggtg

SEQ ID NO: 66463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgccggatccagaaattaaggcattccgc

SEQ ID NO: 66464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgccggatcgacggaggggtcacagttag

SEQ ID NO: 66465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcgatactggctcctgcagccaccgtgg

SEQ ID NO: 66466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcgatcgacatgggcagggcatcggtcg

SEQ ID NO: 66467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcgcaggtggagcagttgactatggcgg

SEQ ID NO: 66468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcgcatcggtcactactaccctttatga

SEQ ID NO: 66469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgcggactcgcaaagggggagcgcactgt

SEQ ID NO: 66470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgctgattccggcttacagctcagttacc

SEQ ID NO: 66471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgctttgacatccgcgatatgtcatgccg

SEQ ID NO: 66472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggacaggtgagtccatgacggcttacgt

SEQ ID NO: 66473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggagaggcagggcgacctatgtttccac

SEQ ID NO: 66474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggagagtttcgtccaggcaaatggtgca

SEQ ID NO: 66475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggatcatgtgaactaacggtgtgcaccg

SEQ ID NO: 66476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggccgtcccaacaaaaagaatgcgctcg

SEQ ID NO: 66477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggcgcgcctttcctatacggcttgatcc

SEQ ID NO: 66478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggctccgttaaatggcggcgggtaggtc

SEQ ID NO: 66479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgggctaagcttgtccgtgcgaggccttg

SEQ ID NO: 66480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggtaatggccggaacgtcaccgggcttg

SEQ ID NO: 66481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggtcaacaccgtaatgccactgctgtaa

SEQ ID NO: 66482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggtccattttgggtattgctgatctcat

SEQ ID NO: 66483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggttgggtgccgtgttgaagcgagggca

SEQ ID NO: 66484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacggttgtcttaactgaagctctgatgctt

SEQ ID NO: 66485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgtaattagttagtcaacatgttgcacga

SEQ ID NO: 66486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgtactgttgcatagacaaatctagcccc

SEQ ID NO: 66487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgtagggcattacgcgaacaggcatggtg

SEQ ID NO: 66488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgtgaacattgacgcgtggccaccatgtc

SEQ ID NO: 66489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgtgtcatagaccacaggttcgcaacttt

SEQ ID NO: 66490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgtgttgaccttttcgggaaccatctcac

SEQ ID NO: 66491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgttcggtaatggccgactgccccgtccg

SEQ ID NO: 66492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgttcgttggccagcctcggtacgcttgc

SEQ ID NO: 66493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacgtttggtgttcgagagcctatctgtgtt

SEQ ID NO: 66494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactaagggttacatgcgaaagcttaggacg

SEQ ID NO: 66495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactaattgcgaaccagccaggtgccctccg

SEQ ID NO: 66496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactacttgttcataactgtcgccacgtgcg

SEQ ID NO: 66497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactagagtcgtcgagatttgcgcctgtcga

SEQ ID NO: 66498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactagccgggatgtgaggtcgaagtacagt

SEQ ID NO: 66499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactagtcaacagcactcgagctcgatcgac

SEQ ID NO: 66500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactattccgcttgccctcgtgctaacggct

SEQ ID NO: 66501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactcactgtatctgtaagtcaaggcaggtt

SEQ ID NO: 66502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactccgaaatgtacaatggagatttccgtg

SEQ ID NO: 66503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactccgatgatacgtatccggtacagtggc

SEQ ID NO: 66504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactccgtccctaccagtgattgcttagcgc

SEQ ID NO: 66505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactctctagggaacaccctatggtggggtt

SEQ ID NO: 66506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactctggcctgccgtagcgtgttccgggct

SEQ ID NO: 66507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactcttgttggcgcttttgctgatatttac

SEQ ID NO: 66508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgaaatgtacggatgttggatgggtgta

SEQ ID NO: 66509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgaatatcggggcgtccattgcatcaac

SEQ ID NO: 66510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgactgtaatggaacgagttaaactacc

SEQ ID NO: 66511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgccttttcagtgcctgtttagatcagt

SEQ ID NO: 66512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgcgaggtccttaaggatagcctggtgg

SEQ ID NO: 66513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactggaaataaaggacgcgccgacgttgtg

SEQ ID NO: 66514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactggacatttgtaatagtttgggcctcct

SEQ ID NO: 66515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactggcacattatgatatatggctttgaca

SEQ ID NO: 66516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactggcatcattaagcacccccttagagtg

SEQ ID NO: 66517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactggggacgtggagtttatatcgaggcta

SEQ ID NO: 66518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactggtggagttcgtagcagctttggcagg

SEQ ID NO: 66519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgtccaagtgatagtggtgggccgaaat

SEQ ID NO: 66520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgtccgcgcgatgtggagacttttcaat

SEQ ID NO: 66521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgtgtctcccttcgggtaaaacggttct

SEQ ID NO: 66522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactgtgtgcttctgcatgtttaagtattct

SEQ ID NO: 66523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacttagcggggaccttagtatttagcggat

SEQ ID NO: 66524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacttcgcgaccctgagtctttgttgtgggc

SEQ ID NO: 66525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacttcggcttaagcacctgccgtgattgga

SEQ ID NO: 66526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacttgaaattttatccctgacatcggccgc

SEQ ID NO: 66527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgacttgcaacgtgaataaccgaacgaatcgt

SEQ ID NO: 66528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactttactactgtggcatggttcacccaga

SEQ ID NO: 66529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactttcgaccggacgcggttatatcgtgcc

SEQ ID NO: 66530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgactttggccttacagacgtgccccattggc

SEQ ID NO: 66531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaaattggcggtctagacgaggctagcga

SEQ ID NO: 66532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaagactccgagcggcataatcgccaccc

SEQ ID NO: 66533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaagcgcgccgaattattcgggtgggggg

SEQ ID NO: 66534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaagctggcctcctgaactgtgccagagt

SEQ ID NO: 66535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaagtgatagaggttgactattagttcga

SEQ ID NO: 66536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaatcgcgttgccttgatccggccgtgtc

SEQ ID NO: 66537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaatgagaatcatagcaccccatgcaatc

SEQ ID NO: 66538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagacacgtgcagcaatgaaatggacggggt

SEQ ID NO: 66539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagacacttagtgggttcgagtcttgttggt

SEQ ID NO: 66540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaccatatggttgagacgcagggggacct

SEQ ID NO: 66541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagacgggcgaaacgacgaacgtccgctcgc

SEQ ID NO: 66542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagacggtggctggggtctgacattcccctt

SEQ ID NO: 66543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagactccattcacggatcagactatcgcac

SEQ ID NO: 66544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagacttaagatatgtgctgtgcgcgtaggc

SEQ ID NO: 66545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagagaacatggcgtaatcggtctggcgggg

SEQ ID NO: 66546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagagaaggcacccctcggtccggcactggt

SEQ ID NO: 66547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagagacaactgtacggcgactggtccctca

SEQ ID NO: 66548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagagagctgacgtggcatgatggcaggtga

SEQ ID NO: 66549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagagcgcatcacacacaggcgccatcgagg

SEQ ID NO: 66550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagagcggctacatggaagcgcggacaaggg

SEQ ID NO: 66551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagaggaattggcgtatactacggcatgttc

SEQ ID NO: 66552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagagggcaggctggagtttcacgggcgcga

SEQ ID NO: 66553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagagtgcgaggtggcttaggctacggtgca

SEQ ID NO: 66554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagagttgcgtttctcgtccgctctacaggt

SEQ ID NO: 66555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagatcaatgcacgttctgacatggggcgtc

SEQ ID NO: 66556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagatcatttgatgtgaggtttatgggtgat

SEQ ID NO: 66557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagatccgctttagtacggtttgacccctcg

SEQ ID NO: 66558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagatcctcggacgtaatctcggtcttagcg

SEQ ID NO: 66559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagatgtacgcacgggttatagatcgcggta

SEQ ID NO: 66560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagattaagccagactgcaagtgaaattgcg

SEQ ID NO: 66561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagattcgggcttgatctccgttcggtggct

SEQ ID NO: 66562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagattgctagtttcgcttcttcaagttgac

SEQ ID NO: 66563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcaactgccgtctcgatccctgtaatgtg

SEQ ID NO: 66564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcaagtatcgggttcaaacgtgcgttgtc

SEQ ID NO: 66565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcaagtgtagctttagggttctttattgg

SEQ ID NO: 66566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcacaggcgggaaaccaggggacagctct

SEQ ID NO: 66567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcagccggtcgagcagttagtgtattgcg

SEQ ID NO: 66568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcaggtacacgactggcaactagctgacg

SEQ ID NO: 66569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcatcaggcgccgctgaatgggtcccgcc

SEQ ID NO: 66570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcatggtgcgaaccggtcaagtatttcac

SEQ ID NO: 66571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagccaaggtgatagaatctacggctgggca

SEQ ID NO: 66572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagccggaactgtgatttacccgggatccgc

SEQ ID NO: 66573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcctacactttgccaacaacgatgagctg

SEQ ID NO: 66574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcctgctgctctcggcagtagtggggttg

SEQ ID NO: 66575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagccttacggtagtatgtgtactgctgtcg

SEQ ID NO: 66576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagccttgcttgctgcgggcggcgatgtccg

SEQ ID NO: 66577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgaacccaagagaacggattcctcgtaa

SEQ ID NO: 66578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgaatgcaggctactccgatttagggcg

SEQ ID NO: 66579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgacgctgttggctaggggtacgaccgc

SEQ ID NO: 66580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgatactaatccggtcccataacagttg

SEQ ID NO: 66581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgcatcggtatagacgtggctcaacgtt

SEQ ID NO: 66582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgctctgtcttgtgtacgatgcgtttag

SEQ ID NO: 66583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgctggcgaagctaaccaggtgtatccc

SEQ ID NO: 66584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcggcttggtcagttctgacagttgcgtc

SEQ ID NO: 66585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcggttcatcttgcaaacagaggaaggct

SEQ ID NO: 66586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgtaaagcatcgatcccatcggcactca

SEQ ID NO: 66587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgtccataagcaaccgaggacttttgga

SEQ ID NO: 66588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgtcggtaatttggggcggcacacaagc

SEQ ID NO: 66589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgtgctggattggccttagttgcggcgg

SEQ ID NO: 66590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgtgtcaacgtgcgggaagtgggtaaac

SEQ ID NO: 66591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcgttgccggttcaaacaggtctgcgatc

SEQ ID NO: 66592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctactagcgcatcaacattcctagacac

SEQ ID NO: 66593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctagatgatcaaggacattcacgcaata

SEQ ID NO: 66594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctagcaaacaacagtcgtgcacgccgcg

SEQ ID NO: 66595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctagttttcagtacgattagtcttggtg

SEQ ID NO: 66596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctccatcaccgcaagccctatttcgtcg

SEQ ID NO: 66597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctcggggcgccatagtcccacgcctgcc

SEQ ID NO: 66598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctggcaaattggaagccgtcttctgctg

SEQ ID NO: 66599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctggtgtggctgggagggccaggagtta

SEQ ID NO: 66600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctgtaactccgtggtaatacaaggcagc

SEQ ID NO: 66601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagctgtctggccaaccctttctcgctagta

SEQ ID NO: 66602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagcttatagtcatgtacggtcggcgttcgg

SEQ ID NO: 66603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggaaggttgaagcgttcttaccgccctgg

SEQ ID NO: 66604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggaagtcttgatggcaagatagtataatt

SEQ ID NO: 66605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggacggccagggcccggtttctgcatgcg

SEQ ID NO: 66606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggagagtttgcggctcaatatgatgttag

SEQ ID NO: 66607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggagcgggagcaggatcaacgggaaccgg

SEQ ID NO: 66608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggaggccctcgaagagacggtgatacatt

SEQ ID NO: 66609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggagtcgcgcgtcctcgcatattggctcc

SEQ ID NO: 66610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggagtgctggaggggtacggctattgcga

SEQ ID NO: 66611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggagttttggattatcatacgcttttcgt

SEQ ID NO: 66612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggataacctttgcaggggtcgccacttgg

SEQ ID NO: 66613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggatcaccaaagccgagtcagatgcgcgt

SEQ ID NO: 66614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggatctgaacgtgagaccctgtggccgcc

SEQ ID NO: 66615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggatgcactcctagtgagttttgcatcaa

SEQ ID NO: 66616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcacgccatttaagacattcccgttccg

SEQ ID NO: 66617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcactggcgcattccatcactaccctaa

SEQ ID NO: 66618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcagataggggtgaagtggaaggtattt

SEQ ID NO: 66619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcagtttgggatcgggatggtgagaagg

SEQ ID NO: 66620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcatacggctgcaaacaccgagctctat

SEQ ID NO: 66621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcatgtctgtcctacacccctgaccagg

SEQ ID NO: 66622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggccaatccattaaacgagatccatcaag

SEQ ID NO: 66623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggccacaccgcaaccatttaccgtacgag

SEQ ID NO: 66624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggccacgggcgaggtatcaggggcttaca

SEQ ID NO: 66625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcctaaagaaggatcgttgcatacgaag

SEQ ID NO: 66626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcgcccgaaaactgcatcgcctgtggat

SEQ ID NO: 66627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcgccggcaatcccccccaaccacctcg

SEQ ID NO: 66628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcgcgaacgtgatgatcccttgactggc

SEQ ID NO: 66629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcggcgcgatcgtgtcgcctagtgtatt

SEQ ID NO: 66630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcgggatgggctctagttatagccgagt

SEQ ID NO: 66631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcgggtaacgctctcccgttctcaatcc

SEQ ID NO: 66632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggcggtggagttatcgtctagtatcgttt

SEQ ID NO: 66633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggctagatcccagcacattgtatggagcg

SEQ ID NO: 66634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggctcctttgatccgcgtagaccatgatc

SEQ ID NO: 66635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggctgccacttctgtacccgagtctgcgg

SEQ ID NO: 66636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggacagaatactgagtcgcttttcgacc

SEQ ID NO: 66637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggatcatttcgatattagccctgagtcg

SEQ ID NO: 66638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggattaatgcccgctctggtctcgtgct

SEQ ID NO: 66639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggccagacatagtaccgcttgggctgcg

SEQ ID NO: 66640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggccggtctgtggtcatgcaagtgcgca

SEQ ID NO: 66641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggcggtataatctcgaacaatggcctta

SEQ ID NO: 66642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggctcgactctcgtctcctattaggacg

SEQ ID NO: 66643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggctcgtcgctatactaggcgtcttagt

SEQ ID NO: 66644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggggaaacggacagggttatgtcattccc

SEQ ID NO: 66645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggggacggggacttgggttagtgcattgg

SEQ ID NO: 66646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggggagccagacaaaagcggtgagcgttg

SEQ ID NO: 66647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggggatacatgtcgtctttttgcgaacg

SEQ ID NO: 66648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggggtagtagaccggacagggcgacaac

SEQ ID NO: 66649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggggtgttagtcacggtctgaattaccat

SEQ ID NO: 66650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggtatcaattggctaagtgctggccgag

SEQ ID NO: 66651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggtgacccgacatgtacctcgttagatg

SEQ ID NO: 66652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggtgagtgtcaatggataccgtagacgc

SEQ ID NO: 66653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggttctggaccgtggggcccgcagaccg

SEQ ID NO: 66654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagggttgtacggattcgaatgttaggggcg

SEQ ID NO: 66655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggtaccagttcccttaggctcgggcatta

SEQ ID NO: 66656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggtagaggtattaaagtgtgcctcagtcg

SEQ ID NO: 66657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggtattattacaacttctgggcctatttg

SEQ ID NO: 66658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggtccacgtactcataccgtcctattctc

SEQ ID NO: 66659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggtcggacgtctacgtcttggcgtcccgt

SEQ ID NO: 66660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggtggaagggcggcggtacatgtcatttg

SEQ ID NO: 66661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggttagatggggtcccgcaagctgtctta

SEQ ID NO: 66662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggttgccatcgcttgttttataacccaac

SEQ ID NO: 66663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgaggtttggcccacgtccgaagttccaagcc

SEQ ID NO: 66664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtaacctcatctttcacgatgcagagatg

SEQ ID NO: 66665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtaagactgttattgtcaagccttcattg

SEQ ID NO: 66666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtaatgcctccttggtcatgtctagtttc

SEQ ID NO: 66667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtatgacgtgagcatatgccttccggcac

SEQ ID NO: 66668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtgacgtctgccttcggtacgagaactat

SEQ ID NO: 66669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtgatttctctttggtacgagccacatac

SEQ ID NO: 66670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtggacacatacacgcccgcggtgtcgag

SEQ ID NO: 66671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtggtgaaacgctcatgccgagcttagtg

SEQ ID NO: 66672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtgtaaccagtgtagctctctggatgtca

SEQ ID NO: 66673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagtgttccgggcaactctttttggagctct

SEQ ID NO: 66674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagttcaggacgtcgacggatacagcatcta

SEQ ID NO: 66675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagttggcggaaccgagtgaccagcacggaa

SEQ ID NO: 66676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgagttggtattgtgaggtttcgagagcgttg

SEQ ID NO: 66677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgataacgcctgggctgcacacgacagagtac

SEQ ID NO: 66678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgataagctgagtgtttcgatctggcacgatt

SEQ ID NO: 66679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgataaggtagtcacgaacgacattgtttagc

SEQ ID NO: 66680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgataatactgcctgcgaccgggatagacgcg

SEQ ID NO: 66681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatacaatcagccgcgaacaccacgtactgt

SEQ ID NO: 66682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatacacagattaacgttacgtggcgacatt

SEQ ID NO: 66683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatacagtccaaggcagatctgagtttctaa

SEQ ID NO: 66684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgataccccgattgcggtccggtgcaactttc

SEQ ID NO: 66685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgataccgggtgaggggcgttggccgctcgca

SEQ ID NO: 66686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatacgatgagggacatttgtgcagcgttct

SEQ ID NO: 66687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatacgggggctaatgcgacgggacgcaatt

SEQ ID NO: 66688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatacgtccttcttagggcggttttcaggtg

SEQ ID NO: 66689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatactaatccgctggcgacaattccctctc

SEQ ID NO: 66690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatactaggggcgctcgaacctgcttaacct

SEQ ID NO: 66691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagaggctggttaatgtacggatgggggt

SEQ ID NO: 66692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagatattggacgtttcacatgaagatcg

SEQ ID NO: 66693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagattgtcttggccacaaggtgtattcc

SEQ ID NO: 66694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagcacggccgagttggcttggggtgggc

SEQ ID NO: 66695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagcactggcaacaacaccttgagatgtc

SEQ ID NO: 66696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagcggggcttgttgggtgcggcctcctg

SEQ ID NO: 66697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgataggactcgcctccaagccgctatcctgc

SEQ ID NO: 66698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagtaaaagctcggtggtcgttctcgggt

SEQ ID NO: 66699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagtgaagcttatctccagtgcgatgcgt

SEQ ID NO: 66700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagtgccgtatatgggtcgtgaccgttcg

SEQ ID NO: 66701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatagtgctttgacgtgatatacccttgtag

SEQ ID NO: 66702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatatacacggtactgacagtgtcctacgct

SEQ ID NO: 66703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatatcggttcttccggccaaggacgcgggc

SEQ ID NO: 66704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatatgagagttttgagatctctcgactcct

SEQ ID NO: 66705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatatgcttgttcgtttgctattccagtcga

SEQ ID NO: 66706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatattcagaagcggttacacggtgtatgat

SEQ ID NO: 66707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatattccccgtcccgtccgaaggtgctttt

SEQ ID NO: 66708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcaacaactgctcactttaatcttctgac

SEQ ID NO: 66709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcaagtagttacgctctcggcctggtttt

SEQ ID NO: 66710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcaagttaagattaaaagataggtacttt

SEQ ID NO: 66711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcacatgattgtcattatattacttgtaa

SEQ ID NO: 66712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcacatttcaaccatccttgtattaagga

SEQ ID NO: 66713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcacgcagcgtcgttggtcagcatggaag

SEQ ID NO: 66714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcaggcaccctctaatttgtacttcgagc

SEQ ID NO: 66715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcagtcaactgttaaacttcatgcggtgg

SEQ ID NO: 66716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcatgtggtttgtctaccggtttccgtct

SEQ ID NO: 66717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccagcagtcatctcctactgcattaagt

SEQ ID NO: 66718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccatgtggggataaccgaggtctcatta

SEQ ID NO: 66719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccgatgtaccgttacaacctcggtgttg

SEQ ID NO: 66720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccgcgcgtaagttgattcaatttctggc

SEQ ID NO: 66721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccggctaatgcgcagaatacatcgcgcg

SEQ ID NO: 66722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccggcttgggagatattgctattcgtgg

SEQ ID NO: 66723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccgtcggattgaacacgctgtagttccg

SEQ ID NO: 66724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcctggcggataggctgctaccatctagt

SEQ ID NO: 66725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccttatcatgcaggcatatcacccactc

SEQ ID NO: 66726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccttgactcatgatagtacgcactgatg

SEQ ID NO: 66727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatccttgtgcgggggagttactagaagtta

SEQ ID NO: 66728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcgacgtgacacgactcttaattaacccc

SEQ ID NO: 66729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcgagcacatcaagctgcctgccactgta

SEQ ID NO: 66730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcgagccgaagctcggcggatatcgcccg

SEQ ID NO: 66731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcgcactgccttgggtggggcttccgacc

SEQ ID NO: 66732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcgcatttgcgggcgctcgggatacgcaa

SEQ ID NO: 66733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcgccgtgaggaggggaggtatgctggtc

SEQ ID NO: 66734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcgcgttgggatgttttagtcctaaagtt

SEQ ID NO: 66735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcggaaggactacaggcataggattccgg

SEQ ID NO: 66736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcggccccagtagacgacgaatggtgtgc

SEQ ID NO: 66737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcggctaggtgcaacatgcagtatggcgc

SEQ ID NO: 66738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatcgggctcgtgcaacgtaatcgtaggtac

SEQ ID NO: 66739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatctgaaacatgtgatcgcagtaataacgg

SEQ ID NO: 66740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatctgaacggtttgtgaggtagcagttcca

SEQ ID NO: 66741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgaagattggacggggtgttacggcatca

SEQ ID NO: 66742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgaaggatcgacacgcctagtgagcagtg

SEQ ID NO: 66743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgacatacaacatagctggtgccttaccc

SEQ ID NO: 66744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgaccctttgacggcccgggaagttcgtg

SEQ ID NO: 66745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgacttgggtcagtggtgaagccgatccg

SEQ ID NO: 66746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgagcgtgctggttagaatcgtgtacctc

SEQ ID NO: 66747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgagctcgcgtttgggagccccttcgcgg

SEQ ID NO: 66748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgagtgcacttccggtcgcaagaaggggg

SEQ ID NO: 66749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgagttaccgcctctcctgtttacttcgg

SEQ ID NO: 66750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgatagccatcctgcacgtgtgaggaagc

SEQ ID NO: 66751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcaaattctttactaacgtgtgtttaca

SEQ ID NO: 66752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcagagacacgcgtattttagcgggctt

SEQ ID NO: 66753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcaggacctcgggtgctggggctgggat

SEQ ID NO: 66754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcaggcataggcatatctggctttgtca

SEQ ID NO: 66755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcatacgtaatgccccatagggatggct

SEQ ID NO: 66756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgccataggtccgaccagggcatactagc

SEQ ID NO: 66757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgccgatgcgagttggcccagatcacgtc

SEQ ID NO: 66758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgccgttccctccgacgtcgagtgactta

SEQ ID NO: 66759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcgccgcaatattatctaggtgcgtaga

SEQ ID NO: 66760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcgcgctgcacgtggtgcgtcgtcattg

SEQ ID NO: 66761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcggaaactcgattaacgtgccattggt

SEQ ID NO: 66762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcggctctgggttcagcataacagtatc

SEQ ID NO: 66763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcgtgatggtacggagggattatgcagg

SEQ ID NO: 66764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgctaacctctgccgtttaaacggtggac

SEQ ID NO: 66765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgctagtttgcgtcacgcggatccgaaga

SEQ ID NO: 66766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgctcaaatataccagagggcgactcggt

SEQ ID NO: 66767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgctcagcggtatcaggccgagaccggga

SEQ ID NO: 66768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgcttcggggattaggatgtctgggtacg

SEQ ID NO: 66769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatggagcacgcgtaatataagtgattcagc

SEQ ID NO: 66770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatggatcaccccctgtttatgctttcccgc

SEQ ID NO: 66771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatggctagctagctcacccgagggctgggc

SEQ ID NO: 66772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatggctcagtagattcctagagttagccac

SEQ ID NO: 66773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatggctcgagaccatacaatcggcccagac

SEQ ID NO: 66774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgggtcggtctatggtcgctcagattgag

SEQ ID NO: 66775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatggtccgagcctcgtgtcgctgcgtgccc

SEQ ID NO: 66776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtaagagtctaccgcttctgtctgtggg

SEQ ID NO: 66777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtacgttgggacctagtcacgtggggtt

SEQ ID NO: 66778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtaggagcggcctagatatgactggagg

SEQ ID NO: 66779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtaggatcccttcgccctggtttcattg

SEQ ID NO: 66780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtatgcacatatacgatcgcttcaagag

SEQ ID NO: 66781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtcggcctggtgttatcggattgaacat

SEQ ID NO: 66782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtcgggcgtaaaagtacgctacaagcac

SEQ ID NO: 66783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtcggttgtattttaacgccggacgcgg

SEQ ID NO: 66784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtgagatatccagccgggcaggccagtt

SEQ ID NO: 66785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtgaggttccgacacactacaaactcgc

SEQ ID NO: 66786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtgcatcgcgcccgctccggacttaact

SEQ ID NO: 66787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtgtgctgtgagggttggaccaattgtc

SEQ ID NO: 66788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtgttgtgctctgggggccggacagata

SEQ ID NO: 66789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgtgtttgtcggtgaagtgctcccagggt

SEQ ID NO: 66790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgttgctgaacaccgctattcgtctatgc

SEQ ID NO: 66791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatgttgggcagggttccatccatgatatgc

SEQ ID NO: 66792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattaatcagtaaggctagtagcccgtagga

SEQ ID NO: 66793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattacaataacgtgatacctttgcatctgc

SEQ ID NO: 66794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattaccgaacaacttcttaagcgagctgtg

SEQ ID NO: 66795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattagagcgatgttgcattggtgaaatcga

SEQ ID NO: 66796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattagcggaaggtcttctttacccctactc

SEQ ID NO: 66797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattaggtccaaggactcttggtatacttcg

SEQ ID NO: 66798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattatcccccacgctagagatggccggatg

SEQ ID NO: 66799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattattggcatagcgtcttatctgggttct

SEQ ID NO: 66800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattcagtagtgggttgattgacttgtacgt

SEQ ID NO: 66801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattccgcatccagtgttctgcattggtatg

SEQ ID NO: 66802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattccgctgctcttttcattcaagttgtct

SEQ ID NO: 66803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattcggtcagctagcggcacaagctctgaa

SEQ ID NO: 66804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattgacggtaacgcccataataagtggaca

SEQ ID NO: 66805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattgacgttgcctttagcgtaggctacagg

SEQ ID NO: 66806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattgatcgtgttttactgccctgttacccg

SEQ ID NO: 66807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattgcacataccggggtgggggtgtacatg

SEQ ID NO: 66808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattgcgttgggcttaaatatagccccatag

SEQ ID NO: 66809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattgctgcggtcctagtgcaatccccgtcg

SEQ ID NO: 66810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattggcgggatgcggggagtctgcgttttc

SEQ ID NO: 66811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattggctagcagttctccagtggctactgg

SEQ ID NO: 66812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattgggactgttctagcggcgcccgagtca

SEQ ID NO: 66813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattggtaatagcatacgggtgcgcacctac

SEQ ID NO: 66814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattggtatggacaacgcgttgagagatcga

SEQ ID NO: 66815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattgtgtcgggaaactagggcatcgcttgc

SEQ ID NO: 66816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattgttacttcagcgcgtaacccgaattaa

SEQ ID NO: 66817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatttaagctgtcttggcaaacaattcgtgc

SEQ ID NO: 66818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatttacggcttggttgctggagggcgggta

SEQ ID NO: 66819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatttagatggacttgaccgtgggcccactc

SEQ ID NO: 66820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatttcccaaccttcggtggtcgttcggtac

SEQ ID NO: 66821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatttccgcgcgtgcaaactgtcctacagca

SEQ ID NO: 66822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatttcctcggttttcgggtggtcggcggaa

SEQ ID NO: 66823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatttcgctagagggtctgtggaacattttc

SEQ ID NO: 66824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatttgacctaccccggttttgaacgaaact

SEQ ID NO: 66825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgatttggtagcggggcttgactcgtggactg

SEQ ID NO: 66826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgattttttattcggcaagtcatggtttttta

SEQ ID NO: 66827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaaaagttgcggcattccgtcatacccgt

SEQ ID NO: 66828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaaaccttctgggtcagggaatcagcggt

SEQ ID NO: 66829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaaagttacgtgttgcagactatatcctg

SEQ ID NO: 66830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaaagtttacgtactatccccgcatgtct

SEQ ID NO: 66831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaacgaggaagatcacaggaagcgccaat

SEQ ID NO: 66832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaagctggcggagttatcaacatttgttc

SEQ ID NO: 66833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaattctgacagatcgacgcctgcgaatg

SEQ ID NO: 66834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaattgcgcgtgtggcaacctgtcaacga

SEQ ID NO: 66835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaatttcatcgcagtgtacgtcgcacatc

SEQ ID NO: 66836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacacccgagtatgaatcgatgcgtggat

SEQ ID NO: 66837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacagcggttacagccccgattcggttgg

SEQ ID NO: 66838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacataccagttctgttacctttggggct

SEQ ID NO: 66839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaccaatactacctgtcgcggaaagccct

SEQ ID NO: 66840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaccccccgcacacgaacgctatgtcctg

SEQ ID NO: 66841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaccgacgtgcattttcgatgaattctaa

SEQ ID NO: 66842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaccgatgttatctgtttatgctgatact

SEQ ID NO: 66843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaccgcgaagaatcgagagggtggccccc

SEQ ID NO: 66844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaccgcgctgctgttttatccttccgcat

SEQ ID NO: 66845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaccggttgcatacgacgtcatgcctgat

SEQ ID NO: 66846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaccgtacgaacgggcgaggggtggaggg

SEQ ID NO: 66847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacgatacggtggagaagcgggccgaacc

SEQ ID NO: 66848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacggagacataggccactggttgttcac

SEQ ID NO: 66849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacggagtgattatggacggggtggggca

SEQ ID NO: 66850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacgggtcgcaggcggggattggcgcagg

SEQ ID NO: 66851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacgtttcccgattcttagaaaaatttga

SEQ ID NO: 66852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaactaatttaccatttacgaacgctgtca

SEQ ID NO: 66853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaactacaatcgttttatggttgagttgtg

SEQ ID NO: 66854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaactgtgcgcttgcagacgtgagaagctg

SEQ ID NO: 66855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaacttacgggtaacaccggttcgcgccgg

SEQ ID NO: 66856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagacaagtgactgggtgcggagtgttag

SEQ ID NO: 66857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagaccgcactcattgctttatttttttg

SEQ ID NO: 66858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagagggcccccgtgacttcgagctggac

SEQ ID NO: 66859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagagtcacggggtctccctcggtggttc

SEQ ID NO: 66860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagagtgcagatcaccccatcaactagcg

SEQ ID NO: 66861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagagttgtccgtcttccgtttcccgggc

SEQ ID NO: 66862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagcagctgggcaagcgttatgtcggttg

SEQ ID NO: 66863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagcgtatcgggcggggaggagggtcagg

SEQ ID NO: 66864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagcgtcgtaattggttccccttaccctc

SEQ ID NO: 66865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagctccgacgacctgggcgtattcttat

SEQ ID NO: 66866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagctccggatggggggggccgtttgggt

SEQ ID NO: 66867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaggtacaactgcttgtgtaggggatgta

SEQ ID NO: 66868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaaggtgaatttccgacagatccgtcctcg

SEQ ID NO: 66869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagtacgtctgcacgagaggcgatggtgt

SEQ ID NO: 66870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagtagtagccagtctaagagagtctgcc

SEQ ID NO: 66871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagtcgacccaccatgggaattaggctcc

SEQ ID NO: 66872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagttagctgtttagatcgtatagtcgct

SEQ ID NO: 66873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaagttctccccttgcatcggactcggtgg

SEQ ID NO: 66874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatcaggacttcaccgtgattaatcaaca

SEQ ID NO: 66875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatcatgttgggatatgcgatgtattgtg

SEQ ID NO: 66876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatcgcgaatggcgctctccctgatggcc

SEQ ID NO: 66877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatctgtgtccggtcttaatgggatgtgc

SEQ ID NO: 66878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatgaaaacagcgcgcaccgttgggcagc

SEQ ID NO: 66879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatgaacccatgaccacccgagtatggcc

SEQ ID NO: 66880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatgaccgatgggtcttccgtaagtccgt

SEQ ID NO: 66881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatgactaaaggccgcttcttcgcggttt

SEQ ID NO: 66882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatgaggagccaggcctattcggggcgga

SEQ ID NO: 66883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatgggtgcattccccgaggtttggcggc

SEQ ID NO: 66884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaattaccttaaccgcacaattgtcgcatg

SEQ ID NO: 66885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaattgggggcaggccgaatttttcctcgt

SEQ ID NO: 66886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaatttgtcaatgttcactcattcgttacc

SEQ ID NO: 66887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacaaatggccacatcaaactcccaatcgg

SEQ ID NO: 66888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacaacgaggaggtctgattatctcgcact

SEQ ID NO: 66889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacaagtacacgtatctcggtgtgatcctt

SEQ ID NO: 66890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacaagtgggcctccagtaatttagccgtg

SEQ ID NO: 66891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacaatgggcggactcgtgccatgggaagg

SEQ ID NO: 66892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacacaacggagctgtttatgtacgtacgt

SEQ ID NO: 66893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacacagtgaacaacgcattttatacgata

SEQ ID NO: 66894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacacatctttggaactgattatcgtgagg

SEQ ID NO: 66895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacaccccgaccagttcgcgtctcgttact

SEQ ID NO: 66896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacacgcggcgtagttgacatttctgctgt

SEQ ID NO: 66897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacactcacgaaggactttctgatttctgg

SEQ ID NO: 66898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacactcggttttttgtacatttaacgtgc

SEQ ID NO: 66899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacacttttggcgagcgacctcttctggtt

SEQ ID NO: 66900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacagctacacaaacgccgccaccatagtc

SEQ ID NO: 66901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacaggatgcctttcgcggggcgcgccaga

SEQ ID NO: 66902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacaggttagtggcaatgataagagtgtgc

SEQ ID NO: 66903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacagtatgatacagcacagtttttggcat

SEQ ID NO: 66904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacagttcgggtgtttaacggtttcacgtg

SEQ ID NO: 66905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacatccggtccggtactctggctagtgga

SEQ ID NO: 66906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacatccttgtcctccactggggtggggtt

SEQ ID NO: 66907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacatgcgtatcgagcgattctctggattt

SEQ ID NO: 66908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacattcaggaactggctgcctacattgat

SEQ ID NO: 66909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacattctactcttttccggtttaggggta

SEQ ID NO: 66910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacattgccgggggcctccaaagctacatt

SEQ ID NO: 66911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccaagcctcctcggcggccgactcgtat

SEQ ID NO: 66912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccaagctcggacataacttaagcacgcg

SEQ ID NO: 66913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccacgggcggccaatggttatgcgtaac

SEQ ID NO: 66914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacccaagacgggtaacttcgttctcgacg

SEQ ID NO: 66915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccccagctgaccgcggagcaaatggtcg

SEQ ID NO: 66916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacccccagtaccccatcggccgtccgttg

SEQ ID NO: 66917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacccgattatgatggtttccttgtagggg

SEQ ID NO: 66918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacccgcggcctcgggattatacaattccg

SEQ ID NO: 66919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccgaaggtacgtcttggcatccttatcc

SEQ ID NO: 66920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccgaagtggactgccgggtcactacagg

SEQ ID NO: 66921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccgacacatagctttaaggatccgcgta

SEQ ID NO: 66922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccgacgggcctattctcatctagggaat

SEQ ID NO: 66923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccgcctggaggtatctggagcaaagtgc

SEQ ID NO: 66924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccgcgacgggcatgtagttcatctctgc

SEQ ID NO: 66925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccggaagcaaccactgacgcccaccgcg

SEQ ID NO: 66926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccggggcgacgaggcatgtgtgtgctgg

SEQ ID NO: 66927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccgtctgactctgctcgaggccttcatc

SEQ ID NO: 66928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccgtgccatttacttcttggactgctgc

SEQ ID NO: 66929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacctactcaaagcgccgtgggcccggtat

SEQ ID NO: 66930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacctagacactatccgtcacgcatgccca

SEQ ID NO: 66931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacctcatccgctctagtttggcaatcggc

SEQ ID NO: 66932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacctcgctagttatccggtccgggacctc

SEQ ID NO: 66933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacctgtctaccatcttcattgtcgcttat

SEQ ID NO: 66934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccttggggatagatgcgtttgattggct

SEQ ID NO: 66935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaccttgtcggggtgtcggatgttatctgg

SEQ ID NO: 66936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgaccagctttgtgactgagtcaacctg

SEQ ID NO: 66937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgacgtctcaacatcctatgtgccactg

SEQ ID NO: 66938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgacgttaaggcacaatcgacggaactt

SEQ ID NO: 66939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgagtcggagcaagtgaatgttatggtg

SEQ ID NO: 66940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgagtggtaccacgctgccgtgcaaaac

SEQ ID NO: 66941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgcacgagacgttgctacggttacttgc

SEQ ID NO: 66942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgcacgcatatgtcggcatagtgccgct

SEQ ID NO: 66943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgcacggggaaccatcacaccgtcctct

SEQ ID NO: 66944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgcacgtcgtcgctctgatttgcccgga

SEQ ID NO: 66945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgcacttatgcgagattactgctcatca

SEQ ID NO: 66946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgcataacaactcctcttcgcggggttg

SEQ ID NO: 66947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgccgcagcagttccagtgtttggtatc

SEQ ID NO: 66948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgccgcccgttcgtattccgctattcgg

SEQ ID NO: 66949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgcgacgccatcgctaaataacgccgcg

SEQ ID NO: 66950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgcggggctaggccgtgatgcttttcgc

SEQ ID NO: 66951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgctgagtgtcagagtcaaatggtctgc

SEQ ID NO: 66952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacggaccatgcgcgtgggaaagcctctcc

SEQ ID NO: 66953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacggagacggcggatacggattgagccgg

SEQ ID NO: 66954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacggcagcttagcgtgagcttctgcttgt

SEQ ID NO: 66955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacggctcgtctttagttctaacaagcaca

SEQ ID NO: 66956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacggctggccccggagaggcatatgcggc

SEQ ID NO: 66957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacggtcttggatgtctgatgctttggatg

SEQ ID NO: 66958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacggtgcgagactcgtttgcattcacgtg

SEQ ID NO: 66959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgtagacacgcgtcatgacggccatccg

SEQ ID NO: 66960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgtcgagtctgagtttctgtggtcaatc

SEQ ID NO: 66961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgtggactcgtagcggcataatggcgtg

SEQ ID NO: 66962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacgttgcctgtttgggcatggcttttcca

SEQ ID NO: 66963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactacactgaaactttagtatgattcgtg

SEQ ID NO: 66964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactacggattttgggataacacgccacgc

SEQ ID NO: 66965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactagggaaccgtgatgcggcaaaaggcg

SEQ ID NO: 66966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactccaattccaaggcagttcggaggggt

SEQ ID NO: 66967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactcgacacgtggaggtgaaatgactaga

SEQ ID NO: 66968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactcgacttctacgtttacttagaggccg

SEQ ID NO: 66969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactcgtctgtgtgctacagttgactatgt

SEQ ID NO: 66970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactctgtgtcttcataccgattaatcccg

SEQ ID NO: 66971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactgactcttgccagtcgtgtcttggtcg

SEQ ID NO: 66972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactgaggtgcccgtgatagtaggggtatc

SEQ ID NO: 66973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactgcagtattgtggttgtccaacacgtc

SEQ ID NO: 66974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactgcggtcgcactagcacggactcctgc

SEQ ID NO: 66975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactgctccttcagctgtctgaacgatgct

SEQ ID NO: 66976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcactggtaccctaacgcggcaacaacgtcg

SEQ ID NO: 66977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacttggtagttcgtgtcattcatgcaaca

SEQ ID NO: 66978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcacttgtccttgccttcggtgttttagttg

SEQ ID NO: 66979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagaaagacggtgtatgttaaacagtcttg

SEQ ID NO: 66980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagaacgtcagaggctggatggggtgcggt

SEQ ID NO: 66981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagaagaaaacgagcccaaccgcacagttg

SEQ ID NO: 66982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagaattctaatggttttcatctacgcgtt

SEQ ID NO: 66983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagacaccaagggtttcgacaatcatgcgg

SEQ ID NO: 66984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagacattatgacgctccttgctcttattt

SEQ ID NO: 66985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagacccatccgctactcctctgtgtatat

SEQ ID NO: 66986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagacctcggcgcctgctcttacatccagt

SEQ ID NO: 66987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagacggattgtcagccgttccgctgaatg

SEQ ID NO: 66988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagacgtatcgtcgagggcgcactggtcgg

SEQ ID NO: 66989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagagactgagcgcgtagtccgacgtgctg

SEQ ID NO: 66990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagaggaggggttgttggtgttttagcgtg

SEQ ID NO: 66991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagaggggcgtccaattagcggtaaccgat

SEQ ID NO: 66992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagatagagtccgtctgtgttcatatgtcc

SEQ ID NO: 66993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagataggaatttaaatacgttgtgttcgg

SEQ ID NO: 66994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagatagtcgccgcgtgtggaggtccgttg

SEQ ID NO: 66995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagatcacggaggaccataaagctttcagt

SEQ ID NO: 66996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagatcaggacggctggtaacggaggtctt

SEQ ID NO: 66997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagatccccccaacatttgctcgtagcgca

SEQ ID NO: 66998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagatgagtggagtgagtggcggacctctg

SEQ ID NO: 66999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagatgatcctacggttgtgctctgggtga

SEQ ID NO: 67000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagatgcttccgtattgtggaagttaaggg

SEQ ID NO: 67001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagatgcttggatttcgtcgggcggggtcg

SEQ ID NO: 67002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagatgtgacacgcgctaaaacgggtggtt

SEQ ID NO: 67003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagattaattgcttactgtcttgttagtga

SEQ ID NO: 67004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagattagctcaatggcaccgaatagctat

SEQ ID NO: 67005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagattttggtcttctcaggtcgcccagcc

SEQ ID NO: 67006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcacaggaagccacatcatgattttctg

SEQ ID NO: 67007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcacgtaacaacttctccagcagcgcat

SEQ ID NO: 67008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcagcaggcgtgttctacggggcatgac

SEQ ID NO: 67009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcaggcgcactggtagtcgtcggggttt

SEQ ID NO: 67010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcatgtcctaaccggaccttagcgcttg

SEQ ID NO: 67011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcatgttattcgtctagaatgggatgtg

SEQ ID NO: 67012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagccaccgggcgattcagtctgacgcggt

SEQ ID NO: 67013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagccacggcttgatgcttcttgtgtgcgg

SEQ ID NO: 67014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagccattgatgggggcacagctcggttgg

SEQ ID NO: 67015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcccaacaatgcttttcatccgcaatac

SEQ ID NO: 67016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagccgcagttagggtctatttgcacgtcg

SEQ ID NO: 67017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagccggatcgggagaccacactcgctgtg

SEQ ID NO: 67018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagccggtataagttgttcgtgcgatccgg

SEQ ID NO: 67019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagccgtccccggagcgataaaccatgagg

SEQ ID NO: 67020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcctctggatggatctcgttatcgtgtt

SEQ ID NO: 67021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagccttgagttggttggaactctgagggc

SEQ ID NO: 67022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcgaactgcgtcatgggaacctccgcat

SEQ ID NO: 67023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcgacgtcacaggatgaagcggtgcttt

SEQ ID NO: 67024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcgcccgcgatccgaccaccctacggag

SEQ ID NO: 67025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcgccggatgttcagtaatggtgtgctg

SEQ ID NO: 67026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcgcggtccatttctaatgtgcatcacg

SEQ ID NO: 67027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcggagcgaatcgtcggcggattgtacg

SEQ ID NO: 67028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcggccgttaagcggggcgggaatgttc

SEQ ID NO: 67029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagcgggagagaatcaataagtgtacgtat

SEQ ID NO: 67030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagctcaatgcggtgcaaaccgtacttggc

SEQ ID NO: 67031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagctggctggttcgaaggtttaaaacatg

SEQ ID NO: 67032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagctttatatcgtcccaccggtaatccac

SEQ ID NO: 67033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggagccgctgttttggtgttatcctggt

SEQ ID NO: 67034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggagggccgtcacagagaaggggtctag

SEQ ID NO: 67035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggatcgtctcagccgccgccttgctctt

SEQ ID NO: 67036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggattgcaacagtgtatggcccttaagc

SEQ ID NO: 67037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggcaacgggacgtctctgttaataggag

SEQ ID NO: 67038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggcaggctcggaactatctgcggaagat

SEQ ID NO: 67039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggcatgacaggttgttcaccctgtgaca

SEQ ID NO: 67040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggccacttgaagcggatccggtggggac

SEQ ID NO: 67041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggcccgattatcgattaggttttgtttt

SEQ ID NO: 67042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggcccttcattcagtcgacgtatggcgt

SEQ ID NO: 67043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggccggcgagcgtcattgtgtaagtctg

SEQ ID NO: 67044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggcctgttgcggagacccttaatgtccg

SEQ ID NO: 67045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggcgctaaagacgaacatctctctatgc

SEQ ID NO: 67046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggcgggatccatgatagggccgtgggca

SEQ ID NO: 67047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggctaatgtatctggccttgctccggtg

SEQ ID NO: 67048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggctaggttcggaagttcgtgatatcca

SEQ ID NO: 67049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggctgtcacgatgcttggtgctctgcct

SEQ ID NO: 67050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagggaagctttagctggagcgccgtcgta

SEQ ID NO: 67051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagggctctctccgttgcttggtgtatttt

SEQ ID NO: 67052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggggcccgggaccttcaaagccaggttg

SEQ ID NO: 67053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggggctgtcgaatgctctgaggtagacc

SEQ ID NO: 67054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagggggactgtgctttgcgcgttaatagt

SEQ ID NO: 67055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagggggcgaagtaaagtcttgctgtgtgc

SEQ ID NO: 67056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggggttggtgcgggatgctgctctggga

SEQ ID NO: 67057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagggtcagtgaagagttatgcggtggtgg

SEQ ID NO: 67058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagggtgcgacgatagaccttggaagccgt

SEQ ID NO: 67059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagggtggtgctttcctgtgaaagttaagc

SEQ ID NO: 67060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggtaggtgcggacaggattggtcatgcg

SEQ ID NO: 67061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggtcataattttggtatcaattttccgt

SEQ ID NO: 67062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggtccacgaatgggtccactggttcctc

SEQ ID NO: 67063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggtcccgaggtgttaaatcccaggcact

SEQ ID NO: 67064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcaggtgtagacttattaacttaaaatctta

SEQ ID NO: 67065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtacaagaaaaggccaagtaggtggcgg

SEQ ID NO: 67066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtagacgaggcttgaccaaactggctcg

SEQ ID NO: 67067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtcatagtgtttgtcatgcgatcacgtt

SEQ ID NO: 67068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtccaaagttgcggtccgcagtttcgac

SEQ ID NO: 67069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtccggtggtacgcgtcacatgcctggt

SEQ ID NO: 67070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtctgtgggagatcgaggccccggtatc

SEQ ID NO: 67071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtgacgggcgtctgggcgctgggtcctc

SEQ ID NO: 67072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtgcctgttattggtggcccggacacat

SEQ ID NO: 67073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtgctaagtttggcgactcctacctttt

SEQ ID NO: 67074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtgtgcgggaggtcttgcttagttacat

SEQ ID NO: 67075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtgtgtgacttttggttcgtgagctggc

SEQ ID NO: 67076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagttaggcgtgtgggtggattatatgcca

SEQ ID NO: 67077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtttgctacaatgttcaggggccgtatg

SEQ ID NO: 67078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcagtttgtcgaactagatgggggtttgcgt

SEQ ID NO: 67079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcataacgtcagcctaaggcggacaccggcg

SEQ ID NO: 67080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcataagcggtaacacgctattgatctcttt

SEQ ID NO: 67081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcataagttgataaggttgacttgtttaaca

SEQ ID NO: 67082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcataatatctcgagattagtctcgaccgtg

SEQ ID NO: 67083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcataatgctagatccgaggtcccggccaat

SEQ ID NO: 67084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatacaatacgcaacagggtactttcaaag

SEQ ID NO: 67085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatacacgtatcagccagcctcttgcgttt

SEQ ID NO: 67086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatacacgtgggttagcgggtattttagct

SEQ ID NO: 67087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatagaagcgcgtgattacactcagacctg

SEQ ID NO: 67088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatagactctagaattcgtttttttgttct

SEQ ID NO: 67089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatagcgttatcgtccggtttggggtctcc

SEQ ID NO: 67090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcataggaggggtgccagttcagccggtgtg

SEQ ID NO: 67091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatatcatagtgccatgcggatgtagcaaa

SEQ ID NO: 67092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatatgcgggccacgccgacagtggtttgt

SEQ ID NO: 67093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatatggattttcgggatcacggttgctaa

SEQ ID NO: 67094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatattgcgacatttggcgaaatcctaggt

SEQ ID NO: 67095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcacatccctaacctaggttcacttgca

SEQ ID NO: 67096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcagcctgctttagatcgatagctcggt

SEQ ID NO: 67097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcatcgtgggcgcatgtggatagcctgt

SEQ ID NO: 67098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcatgttagctagatatatgtgataagt

SEQ ID NO: 67099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatccaggtgcgccatgcatgcgggtggct

SEQ ID NO: 67100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcccactgtggttgcattgtgtgcggcg

SEQ ID NO: 67101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcccagggaactggaaatgtgcttgctg

SEQ ID NO: 67102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcccgacttataaatgaccagaaggata

SEQ ID NO: 67103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatccgcgcaaggggttcgaccagaagaga

SEQ ID NO: 67104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatccgtcattttccatcagatggtttgag

SEQ ID NO: 67105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatccgtcgagtagttctaattaccccata

SEQ ID NO: 67106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcctagccgcgtaagaacaccccgcgct

SEQ ID NO: 67107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatccttgggcctagcactctgatctcgcc

SEQ ID NO: 67108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcgagaggctacctacattctctgggga

SEQ ID NO: 67109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcgcagctaggccattccgtctgctctt

SEQ ID NO: 67110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcgccaatcgaaccattcgtgccaggcg

SEQ ID NO: 67111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcgccacactgtctgtcttctcgccggg

SEQ ID NO: 67112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcgcgaggaagaaaaacgtattgcgtgt

SEQ ID NO: 67113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcggaccagattgtagacactatcggca

SEQ ID NO: 67114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcggacctgttgcggaggtttgattcat

SEQ ID NO: 67115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcgggggagtttcccctgcttattctcg

SEQ ID NO: 67116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcgtcgtcttcagcgtaggcgttgtgtg

SEQ ID NO: 67117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcgttagtgcaaggcttggtgatggggt

SEQ ID NO: 67118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatcgttcgtttctacacgggcgctcgtgg

SEQ ID NO: 67119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatctattttcggacgttccccagtgcgcg

SEQ ID NO: 67120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatctcatgctctccccaacgtgtcaccgt

SEQ ID NO: 67121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatctcattcatttacctctctcgttagcg

SEQ ID NO: 67122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatctggtgtcctgcacttgctcgcggctc

SEQ ID NO: 67123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgaggctcaacgaacgggaggtagtggg

SEQ ID NO: 67124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgagtgcgggtaatgccttgttcagtgt

SEQ ID NO: 67125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgcacaaaatgagcactatacgcgcgtc

SEQ ID NO: 67126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgccgtgattcttaaccctgggacgact

SEQ ID NO: 67127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgctcgagacgtcgatagctcagtacac

SEQ ID NO: 67128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgctgcaacctatcgaaatatggtctcg

SEQ ID NO: 67129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgcttgaggctctcgacagtcacggggc

SEQ ID NO: 67130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatggctgggaagttctgttgaggtgtgtg

SEQ ID NO: 67131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgggctagtttgcagaattcacttagga

SEQ ID NO: 67132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatggggacaatgattcaggcccagacgct

SEQ ID NO: 67133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgggggtcttttatcttgggaacgccaa

SEQ ID NO: 67134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatggggtgacatcgaatcattgttgaatt

SEQ ID NO: 67135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgggtaattgggcctgaaaccagactcc

SEQ ID NO: 67136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatggtcgggacgaaacggcaagtgcaccg

SEQ ID NO: 67137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatgtttccctggcctcagtgtccgcttct

SEQ ID NO: 67138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattaatatacctaccaccccgttatcttg

SEQ ID NO: 67139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattaccaggagtggcgtttgctgtcacgg

SEQ ID NO: 67140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattaccttgggacattgtgacactccttg

SEQ ID NO: 67141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattacgtatgacgtcagattatcgtgtgt

SEQ ID NO: 67142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattacttcctgtgccactagcgtaccgat

SEQ ID NO: 67143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattaggcgagcatagcgtgtccatacatc

SEQ ID NO: 67144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattcaggtatgatcggcccagcatcacgt

SEQ ID NO: 67145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattcagtagtcgtccgcgcgcttgagagt

SEQ ID NO: 67146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattcccacaatcgctatatagttcttcgt

SEQ ID NO: 67147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattccgaacttattagctgtagcatatcg

SEQ ID NO: 67148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattcgctcttttaaaggtcgatctgggcc

SEQ ID NO: 67149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattctagtacgagatcttggagcgaggcc

SEQ ID NO: 67150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattcttgtggtatccgtttccatgctgtc

SEQ ID NO: 67151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattgatattagggagataattttagtact

SEQ ID NO: 67152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattgccatttatgccatttgggggcgccg

SEQ ID NO: 67153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattgccggacagtagcacgggcgaggggg

SEQ ID NO: 67154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattgtggcgaaacctaagttgcgactaca

SEQ ID NO: 67155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatttaaacatccctgcatcgttctcccct

SEQ ID NO: 67156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatttcagtcgggaactgatggggcttgtg

SEQ ID NO: 67157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcatttggacaacgccgtgtgccctcaccta

SEQ ID NO: 67158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcattttatcgaaataggcagattgtttgat

SEQ ID NO: 67159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaaacgacaaaaacttatgggacaccttt

SEQ ID NO: 67160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaaagccattaggttgcaggtcgtctaag

SEQ ID NO: 67161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaaagggtcggacacaaggcagtacaccg

SEQ ID NO: 67162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaaaggtttacaagttgcaagaacgtgat

SEQ ID NO: 67163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaacaatgtccggctttgttccatatgtt

SEQ ID NO: 67164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaacacggttctgcgggtctactttttgc

SEQ ID NO: 67165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaaccgggctttattttgttggactcgtt

SEQ ID NO: 67166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaaggaagtcgctgtataccgctgtctgc

SEQ ID NO: 67167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaagtagctgcacgactacggcgggatac

SEQ ID NO: 67168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaagtccgttcaggggtggattgtcgacg

SEQ ID NO: 67169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaatacatcctcaatgcacgcgagatggc

SEQ ID NO: 67170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaatcaagcgaatattgacagaaggtaat

SEQ ID NO: 67171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaatcgccacggcatactggggagtcagc

SEQ ID NO: 67172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaatgggactcaaattgcataaagcctag

SEQ ID NO: 67173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaatgggtcagtaggttgcaccttctcgg

SEQ ID NO: 67174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaatgtggtagcgctggacgattgcattg

SEQ ID NO: 67175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaattacttaaaacggaggttctctcgcc

SEQ ID NO: 67176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccacaagaggagtccgtccatatttacttg

SEQ ID NO: 67177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccacacgacgagacaacgatttgattgggc

SEQ ID NO: 67178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccacaggaccgcgctaacagagcacgccgc

SEQ ID NO: 67179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccacattgagagttctgcgatcctgcggat

SEQ ID NO: 67180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccacccagcactgcgtccaggtcgtctagg

SEQ ID NO: 67181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaccccgtaccaagaaggcgtttcattgc

SEQ ID NO: 67182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaccggacgtgctttattctatgcgatta

SEQ ID NO: 67183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaccggttgttcaacgcgtcccgcccctc

SEQ ID NO: 67184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaccgtgcaattcccgtgccgatcatagg

SEQ ID NO: 67185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaccgttggcatattggggttgtgacaag

SEQ ID NO: 67186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccacctcgcatctgcgtgtgcgcattcttc

SEQ ID NO: 67187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccacgaggaggtgactcagtcgcaggggcc

SEQ ID NO: 67188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccacgcgaagatggagtaacagcacggatg

SEQ ID NO: 67189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccacgcgggatcaaatactgcagggcgatg

SEQ ID NO: 67190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccacgctagcaattgcctggagaattacct

SEQ ID NO: 67191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccacggaattacaacggacaaccatgtgac

SEQ ID NO: 67192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccactggcgcgtgccttcggattcggctat

SEQ ID NO: 67193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagaacctacggtggagtaatgtctagtg

SEQ ID NO: 67194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagactaataatgcttaatggaagtctgg

SEQ ID NO: 67195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagacttgtggggcacagcaactgacctc

SEQ ID NO: 67196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagagattagtgggtgcctggtactcggc

SEQ ID NO: 67197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagatcccgcggtacacatacggtctcgt

SEQ ID NO: 67198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagatctaggtcggttgtattcagggcct

SEQ ID NO: 67199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagcaacgtgtctccggcatgttctcgtc

SEQ ID NO: 67200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagccaaacgtaaagatcctcaatgggtg

SEQ ID NO: 67201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagccaatcgacgaattcgtatgagtcat

SEQ ID NO: 67202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagcgagaaccagctacgacctagttcgt

SEQ ID NO: 67203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagcgggaaagagtttcggtgtgggggat

SEQ ID NO: 67204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagcgtggtattggctcgttgtcttgagg

SEQ ID NO: 67205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagctcatatcgttattgtcaagtaatgg

SEQ ID NO: 67206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagctgagtccggtcaccttcctctaccc

SEQ ID NO: 67207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagggggtttttggtcgattcaccggtgt

SEQ ID NO: 67208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagggttgaacacgtgaggtgagttgtta

SEQ ID NO: 67209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccaggtgacagagccacgggcatgacatac

SEQ ID NO: 67210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagtccaaaaatggtactgattagggtgc

SEQ ID NO: 67211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagtggattcgtcaagattaggccttata

SEQ ID NO: 67212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagtggggattaggggtacgggttcaccg

SEQ ID NO: 67213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagtgggtcagcctttgaactccgcctcg

SEQ ID NO: 67214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagtgtcccatccgtgtgtccgattcctg

SEQ ID NO: 67215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagtgtttcatgcttcatgttgacttttt

SEQ ID NO: 67216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagttaccgaagctgaccagtcttggagt

SEQ ID NO: 67217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagttatcgattaacgcctccgtgtgttg

SEQ ID NO: 67218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccagttgcgtacctgaccgcatacctaagg

SEQ ID NO: 67219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccataaatccaccccatcttgtgccgggcc

SEQ ID NO: 67220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccataagcacgacagccactccaaccgtcg

SEQ ID NO: 67221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccataagcatcctccgttcggtactcacga

SEQ ID NO: 67222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatagatccaactctgtattgtgccgcgg

SEQ ID NO: 67223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccataggttgcgaatatctggtcaacgcgg

SEQ ID NO: 67224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatatctctcgactggctcgctgctgggg

SEQ ID NO: 67225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatcaactttgtactgattttctttggca

SEQ ID NO: 67226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatcatgccgacacgttggaagatgtgca

SEQ ID NO: 67227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatcattcctgtaagacttgggaagcatg

SEQ ID NO: 67228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatcgacgacgtgattatgcgttcgtcac

SEQ ID NO: 67229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatcgcgaaagggaattgcgtggctgtga

SEQ ID NO: 67230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatcgggatgagtcaatctttccggcgtt

SEQ ID NO: 67231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatcgtgtgggataactctgggttgcacc

SEQ ID NO: 67232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatcgttccccacggttctttccagggat

SEQ ID NO: 67233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatctcatctgccgagggtgtgcttatca

SEQ ID NO: 67234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatgacgggcaaaatagtagaatgtatcg

SEQ ID NO: 67235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatgagtgcttaagtaaaagggagccggt

SEQ ID NO: 67236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatgcagcaaaagccatatcgttgcgcgg

SEQ ID NO: 67237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatgtttccggtgatgatagtaaatgccc

SEQ ID NO: 67238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccattctagtaccacgattcgtacgcgggt

SEQ ID NO: 67239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccattctgtctacttaggatgtagcgcccg

SEQ ID NO: 67240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccattgacaaatgcacaaggtactgcaggt

SEQ ID NO: 67241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccattgatctgagctcaatggttgtgttca

SEQ ID NO: 67242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccatttccagcgttgtctaagccccccagc

SEQ ID NO: 67243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccaacactagcatgattaaagcgcgtcgg

SEQ ID NO: 67244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccaaccccgcaggattagtacgtaaatca

SEQ ID NO: 67245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccaagcggcagatatctatggccggctca

SEQ ID NO: 67246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccaaggagacagtctcggtggttatctga

SEQ ID NO: 67247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccaagtcttccacagggctagtgtctggg

SEQ ID NO: 67248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccaatgtacatcgccgctccacagatcga

SEQ ID NO: 67249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccacatgttcacttcagatacgctgttgc

SEQ ID NO: 67250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccaccgggactttcgctattttttctcct

SEQ ID NO: 67251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccacgaaggatcagggtggactacgccgt

SEQ ID NO: 67252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccactcggcggttttagctacgcgtgtcc

SEQ ID NO: 67253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccagatacacttgccgcgacatggcgtat

SEQ ID NO: 67254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccagcataggggacaagtagagggccccg

SEQ ID NO: 67255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccagcgtgcttaagggtcttcgttaggcg

SEQ ID NO: 67256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccaggagttgcacaactcagtgatcgaca

SEQ ID NO: 67257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccagtaattctcggtcttgtctgcaagtt

SEQ ID NO: 67258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccatacattcttgtatttctcttactcgc

SEQ ID NO: 67259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccatatcctgtcctcttgcgagtggctgg

SEQ ID NO: 67260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccccatatagcggggtcgttagcgctactt

SEQ ID NO: 67261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccccatcggtaaatgcgcccgttccagccg

SEQ ID NO: 67262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccccatcgtaacacgtgaattgccatgcgt

SEQ ID NO: 67263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccccatgagaggataggcttgccgctgtgc

SEQ ID NO: 67264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccccccgtttgcgcgtcgtcaaagtgttg

SEQ ID NO: 67265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccccctgtcgcgcattgaaggttgatcctc

SEQ ID NO: 67266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccccggtagccagtgcgtcatttcttagta

SEQ ID NO: 67267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccccgtagcatgtaattaccctcagcctgg

SEQ ID NO: 67268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccccgtttaaatgttacgctcgtggaagtg

SEQ ID NO: 67269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccccttcttacaacagggatttgcgagtcg

SEQ ID NO: 67270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgaacggacatccgagttgcgttttgcg

SEQ ID NO: 67271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgaagcgcaggtgggattttgcctgccc

SEQ ID NO: 67272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgaggaatggggcgagcagagactggtg

SEQ ID NO: 67273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgatacctactggactacctttcgggtt

SEQ ID NO: 67274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgatctgcggatggtggtagcatggcgc

SEQ ID NO: 67275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgattcttgagccggtgtgcatgcctgg

SEQ ID NO: 67276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgcaccacctttgttcagacacggccgc

SEQ ID NO: 67277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgcagattacgacctgacgacctgtcga

SEQ ID NO: 67278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgcatttattcacggttgataagtcctc

SEQ ID NO: 67279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgccggtaagagttgaagctcagaagtc

SEQ ID NO: 67280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgcggtaaccattcgtacctagtcactt

SEQ ID NO: 67281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgggactttgcttcattttcgcgcgacc

SEQ ID NO: 67282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgggaggcgctcatgttagcattaacct

SEQ ID NO: 67283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgggctggtaagggatgtattaaccttg

SEQ ID NO: 67284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccggtccgccgttatatgtgagagtgtgt

SEQ ID NO: 67285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgtaatgtccttggttagtacatgtgat

SEQ ID NO: 67286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgtaggttaaacgtttggcgatcgtaga

SEQ ID NO: 67287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgtgacgacactgatttggccttttcgt

SEQ ID NO: 67288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgtgcatgaatgtatggcccggcgctgt

SEQ ID NO: 67289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgttaccgataagggcccgacgggaaga

SEQ ID NO: 67290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgttggtacttgcgtagacggagcatga

SEQ ID NO: 67291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccgtttgtttcatcctgaagaacgctggg

SEQ ID NO: 67292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctaaaagtgtaatcggtttgtgttggta

SEQ ID NO: 67293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctaagtatacgcctaataaagcggttat

SEQ ID NO: 67294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctacggtcgcccatgatcggtcagggag

SEQ ID NO: 67295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctagggcgatctgacttacatgccagcg

SEQ ID NO: 67296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctatcatgtctgtcacacgctcgaggcg

SEQ ID NO: 67297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctatttccatccgccaccggagtgctcg

SEQ ID NO: 67298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctcatcacggtctcactggtatcggctg

SEQ ID NO: 67299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctccaatcagtggtcaatgcactgcttc

SEQ ID NO: 67300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctcgatccggcgctggttttgcgggtgg

SEQ ID NO: 67301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctgcaatttggcaagccgcaagtttaag

SEQ ID NO: 67302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctgcggttctatttgttccgtcgtatga

SEQ ID NO: 67303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctggcttgaaatgcatggtaattgtgct

SEQ ID NO: 67304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcccttgagtggcggtggcacatagtgttaa

SEQ ID NO: 67305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctttaccgtctatgaaagcactcgtgtc

SEQ ID NO: 67306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccctttctcggtgtacgcaggaggcgggtc

SEQ ID NO: 67307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgaaagcatgtttaatagccggtccccgc

SEQ ID NO: 67308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgaactcctgggacaaggtcaaaaacgtc

SEQ ID NO: 67309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgaagggggtcactcgtccgggtgaatag

SEQ ID NO: 67310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgaatcgggtgaaatccccgttggattgg

SEQ ID NO: 67311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgacatgtagaccgactcgggttccgccc

SEQ ID NO: 67312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgagatccagtggggatggtattcctctg

SEQ ID NO: 67313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgagcaatggggtttgtaatcgacagcgg

SEQ ID NO: 67314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgagcagtaggcgcgaaatggtctcaacc

SEQ ID NO: 67315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgagcctagaatttgagtcacaagacgcc

SEQ ID NO: 67316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgaggaggggcgtgctcgagagcagggcg

SEQ ID NO: 67317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgaggccgtgacatgaacgcaaataaccc

SEQ ID NO: 67318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgaggggtcccacgctcctaccgcattgc

SEQ ID NO: 67319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgaggtagcgggaccgagagtcagcgtgg

SEQ ID NO: 67320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgagtcttggagaattattggatcccttt

SEQ ID NO: 67321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgagtggatcgcagtgcgtgattcgacct

SEQ ID NO: 67322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgatatactgatatctgggagtcggtagc

SEQ ID NO: 67323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgatcaaaccagattgcattctcttatcc

SEQ ID NO: 67324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgatccagcgtagtgttggcctctttgcc

SEQ ID NO: 67325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgatcgcgcagtgttaaggcgaaagtcgt

SEQ ID NO: 67326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgatcgcgctagtgtaggtctgctgcctc

SEQ ID NO: 67327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgatcgtcaattgcacagccggggtccca

SEQ ID NO: 67328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgatgacaaacgtattgcttctctggttg

SEQ ID NO: 67329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgatggtaccaggatcatgttggcacgca

SEQ ID NO: 67330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgatggtgtcccatgtttcgggagcaacg

SEQ ID NO: 67331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgattatgggggtgggggcgcgacaaatc

SEQ ID NO: 67332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcaaactgcctcggtgtctttgtttatg

SEQ ID NO: 67333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcaaaggatatgaagttgtgtattggcg

SEQ ID NO: 67334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcacagtgaatgccggacgtatgcagcg

SEQ ID NO: 67335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcaccgtggctttaggacctaacgtctg

SEQ ID NO: 67336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcacctaacctaaatgattgcctcgacg

SEQ ID NO: 67337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcacgacgaccaacgtcccccgaagagc

SEQ ID NO: 67338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcagatggaatactgatcgcgatttgta

SEQ ID NO: 67339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcagcggccgtatgttttggcctaatat

SEQ ID NO: 67340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcaggaattcgaaatcaacacccggccg

SEQ ID NO: 67341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcaggccaaacagtgctgcccccacatc

SEQ ID NO: 67342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcagtataggaatggtcactcgtatgtg

SEQ ID NO: 67343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcagtgcatctcagaggagaagggttgc

SEQ ID NO: 67344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcataggccctttgaggactgggtactc

SEQ ID NO: 67345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgccagtaacgatgcttgacccacctgtg

SEQ ID NO: 67346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgccatacggatgccacttctagttttgt

SEQ ID NO: 67347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgccccaaccacgacgtttgtgctgtgca

SEQ ID NO: 67348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcccgtatagtcaaggctgggtgagaca

SEQ ID NO: 67349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcccgtttggttgctctcgtggcggcgc

SEQ ID NO: 67350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgccgtttgaggagcgcaggttgtattat

SEQ ID NO: 67351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcctaaactgcctacttaccgatgctac

SEQ ID NO: 67352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcctggtctacttctcttgacccttggg

SEQ ID NO: 67353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcctttattgcatctacagagttcagct

SEQ ID NO: 67354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcgaaagatgtggtctcgcgtaacgtag

SEQ ID NO: 67355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcgagacactgccaaactgactgggtcc

SEQ ID NO: 67356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcgagatcggcggtatggagcctctgag

SEQ ID NO: 67357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcgcgcctaatcgatattgcgggtggta

SEQ ID NO: 67358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcgctccgcgtactgtggagaccaagtg

SEQ ID NO: 67359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcggacttgagagttccgacctacgatc

SEQ ID NO: 67360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcggcacgttgactacgtagttggtgca

SEQ ID NO: 67361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcgggttcctgatcgtcaatgccctgtg

SEQ ID NO: 67362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcgtccatcagtatgtgtacgttacccg

SEQ ID NO: 67363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgctaattggccagctagtttaagggatt

SEQ ID NO: 67364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgctagtacaggccggtaatgcctcgcaa

SEQ ID NO: 67365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgctctttacgtttggggaattggctagt

SEQ ID NO: 67366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgctggaagataaggccttggtctgctcg

SEQ ID NO: 67367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgctggtatggaaagtcaccaaccccctt

SEQ ID NO: 67368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgctggtgtcgcgtcagattcgcgctatc

SEQ ID NO: 67369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgcttcctgtacatttgaagttgaatgat

SEQ ID NO: 67370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggaccccgcaacggagcaacattcacct

SEQ ID NO: 67371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggatggagcgtggatctattggttctat

SEQ ID NO: 67372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggatgggtactctgcgggggttgcataa

SEQ ID NO: 67373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggattttggcgtggtgtacttcacgttc

SEQ ID NO: 67374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggcacaatggccgctgaatgatgctgct

SEQ ID NO: 67375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggcactggatcggagacttcgcgaccca

SEQ ID NO: 67376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggcatagcaggattcgggcggaggctct

SEQ ID NO: 67377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggccaaatcgcctgtttgtgaggtatgg

SEQ ID NO: 67378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggcccgattgtccacactgtcggttcgt

SEQ ID NO: 67379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggccgccacaacatggtgtttagctagt

SEQ ID NO: 67380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggcggctacattataattgtattcatgt

SEQ ID NO: 67381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggcgggttatggtcgtaatggagggtgt

SEQ ID NO: 67382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggcgtcgtggtacgtagtcgtaataaac

SEQ ID NO: 67383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggcgttatagcgcagtgtagactcattt

SEQ ID NO: 67384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggctgcgtgtgctatcatctgttgtcta

SEQ ID NO: 67385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgggataccaaaaatcgcttggaaccggc

SEQ ID NO: 67386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgggcgtcacatctgtttgtaagcacttc

SEQ ID NO: 67387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggggggtacttgtgcagacgttcggttc

SEQ ID NO: 67388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgggtctcggtggccaacgtgcttatccc

SEQ ID NO: 67389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgggtgcgcttctagaagtgattcctcaa

SEQ ID NO: 67390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgggtggtcatgggtcatctcgtcatgcc

SEQ ID NO: 67391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggtatctaagtcgtacgctcggaatcaa

SEQ ID NO: 67392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggtccaggaatgttgtactatgtgacgc

SEQ ID NO: 67393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggtgcgttctcctctgtttcgggagccg

SEQ ID NO: 67394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggtgttgggtcttgtgatcttcgttggt

SEQ ID NO: 67395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccggtttattccgcagttgtttcgcagcca

SEQ ID NO: 67396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgtagccattaccggaactaggtcggggt

SEQ ID NO: 67397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgtaggaactgagatatcaggactgcagt

SEQ ID NO: 67398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgtaggatcagtcagtgccagaatagggc

SEQ ID NO: 67399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgtatcagtccgccacgttagtagaactg

SEQ ID NO: 67400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgtccgggctgtgttgttcgccacttcga

SEQ ID NO: 67401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgtcctcacacgcttgttgaaccaagaag

SEQ ID NO: 67402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgtgccagcgattcgactctccgccgagg

SEQ ID NO: 67403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgtgggttcagttcctcgttctctccttg

SEQ ID NO: 67404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgtgttaattcgtaaggtactcggaagag

SEQ ID NO: 67405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgttatgaacttgatacactggataaggc

SEQ ID NO: 67406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgttatgcgcgttcgattacctttctcat

SEQ ID NO: 67407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccgttgttgatgcgccggtataatggtgag

SEQ ID NO: 67408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctaactctgcgttgacacggttgcgtctg

SEQ ID NO: 67409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctaatatcgtcctagccagctctgtctga

SEQ ID NO: 67410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctacatgcacggcgcggtgctaggacgcc

SEQ ID NO: 67411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctagccatacgtaatcgacggtggtcctc

SEQ ID NO: 67412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctagctaggccggccggagcttcgtttcg

SEQ ID NO: 67413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctaggaatcgtcgaccagtgtggcgcctc

SEQ ID NO: 67414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctatatcaatcaagctttagttcgcgcta

SEQ ID NO: 67415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctatgacgtaaacgtagccacggttcaaa

SEQ ID NO: 67416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctatgcctcgactcaaaacagcggtctct

SEQ ID NO: 67417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctattgggttggcgactcctataaccggg

SEQ ID NO: 67418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcaattactgcgtgacttgatttaggta

SEQ ID NO: 67419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcaattatccacccgagtgccgcttacc

SEQ ID NO: 67420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcacaacgctagccatgagataattgcg

SEQ ID NO: 67421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcacgaccgatcagctatcctgttgctc

SEQ ID NO: 67422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcagcgcaaccattcaattttagcgaac

SEQ ID NO: 67423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcagtcgcttgaagtagtcgagcactcg

SEQ ID NO: 67424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcatccgcacgttcaggtgggcaacccg

SEQ ID NO: 67425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcatgatacggcttttcggtttcctgtg

SEQ ID NO: 67426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctccatcgaagctcgaatcactgcttgga

SEQ ID NO: 67427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctccgagagctcgcctgtgcgtctgtcac

SEQ ID NO: 67428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctccgaggtcattcaccaaagaagcaccc

SEQ ID NO: 67429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctccgcgactcacggcttagagtacgtag

SEQ ID NO: 67430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctccgcgcggctttctccgtagcaacgtc

SEQ ID NO: 67431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctccggggatagctcacttcacctgacaa

SEQ ID NO: 67432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctccgtcctgttttgtctcctcttgttat

SEQ ID NO: 67433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcggaacatctgctctgaatgggtggtg

SEQ ID NO: 67434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcgggtgttctgtttagcaggctttgta

SEQ ID NO: 67435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcggttccgtagcgctgcccagccgtgt

SEQ ID NO: 67436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcgttcttcttgttgggtctcggccgtg

SEQ ID NO: 67437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctctggatagagcgaagcttgcgtaacgg

SEQ ID NO: 67438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctcttgcactggacgggagtattgtcggg

SEQ ID NO: 67439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctctttctatggcacaattgaattagtgt

SEQ ID NO: 67440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctgccagttacgtcggttccgtcagcggc

SEQ ID NO: 67441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctgcccgtccctgactgagcccttgtccc

SEQ ID NO: 67442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctgccttggtcttcatagctttagggagc

SEQ ID NO: 67443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctgctgcttgccgcgtctaacgggttgcg

SEQ ID NO: 67444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctggcatttaagcgactaccaatggcacg

SEQ ID NO: 67445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctggcgctggtcccataccggcaagcacg

SEQ ID NO: 67446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctggcttgccttttaggcccgagttaaca

SEQ ID NO: 67447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctggggaagagggtgctgtgggctggtcg

SEQ ID NO: 67448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctggggggtgtcagtgtggggcggtcagc

SEQ ID NO: 67449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctggtacgtagcaggaggtggccgcacca

SEQ ID NO: 67450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctggtgcatttaggtttatgcatttcgtc

SEQ ID NO: 67451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctgtcatatcattcaaggaggtctgttct

SEQ ID NO: 67452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctgtccgtcattcgttcactgttgtttat

SEQ ID NO: 67453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctgtcttcccggttagtgcctttatgttc

SEQ ID NO: 67454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctgtgcacttagtaacctataacacgagg

SEQ ID NO: 67455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttaacaggaggaaagaataacgcttgat

SEQ ID NO: 67456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttaaggaagtttcgtgacatgcctgcta

SEQ ID NO: 67457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttaatctaagtccctatactccccaagt

SEQ ID NO: 67458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttaccgaggggtgccaatgtgggatgga

SEQ ID NO: 67459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttaggatgtgccgctccattaaagtggg

SEQ ID NO: 67460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttatagtgacacgggcggtgggggagct

SEQ ID NO: 67461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttcaacactcgtccgatttatcgttggg

SEQ ID NO: 67462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttcaacatgagcaaggcctgttatgtat

SEQ ID NO: 67463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttccgtctgctcaaccatccatggggtg

SEQ ID NO: 67464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttcctcgtagcgtagtgtcgatgttggc

SEQ ID NO: 67465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttcctgaaacctagcattcttgacttgc

SEQ ID NO: 67466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttcctggtctgagacgcttctacggtta

SEQ ID NO: 67467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttctgtgctgaacggctggtctgtaggg

SEQ ID NO: 67468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttgagtgctgtggtccacgcagagtgct

SEQ ID NO: 67469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttgatgtacttgcctggcgatcgcagaa

SEQ ID NO: 67470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctttagatcggtcgtctcaggcgcagggt

SEQ ID NO: 67471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctttccataacacgatgtgtatgtatccg

SEQ ID NO: 67472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctttccccgaagcgtagatggactctgct

SEQ ID NO: 67473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctttcgatcagcatcatccgtcgagcgtg

SEQ ID NO: 67474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcctttgctcagcgtcatattaaggatccta

SEQ ID NO: 67475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgccttttgctgcagtgtgttgcctgtcgttg

SEQ ID NO: 67476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaaacaacaggtgtgaaggatctcgtagg

SEQ ID NO: 67477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaaacatgaataaagaatatcgtgtacat

SEQ ID NO: 67478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaaactgccaatcaacggccaacaaggtg

SEQ ID NO: 67479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaaatacatgcgataattagatggcttct

SEQ ID NO: 67480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaaatgtcagcaaggcgatctactcgaga

SEQ ID NO: 67481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaaatttttgtactgtgtaacaaagccgg

SEQ ID NO: 67482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaacacccgacgctttgatgtctgattgc

SEQ ID NO: 67483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaaccacgctcacaacaggagccgcgtca

SEQ ID NO: 67484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaacgaggaggaggcgcgaggcctaggag

SEQ ID NO: 67485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaacgatacggtggcggtgctgtctttac

SEQ ID NO: 67486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaacgatcatagagccggctaacttgtat

SEQ ID NO: 67487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaacgcggcacgtcactttgtggctgagg

SEQ ID NO: 67488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaacgtcctgggctcgtatggctatgaag

SEQ ID NO: 67489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaagaaggcgggtctacatggatgttgtc

SEQ ID NO: 67490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaagccacacccgtgaatctggctgtctt

SEQ ID NO: 67491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaagcctgacgatagtacacggttgatcc

SEQ ID NO: 67492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaagcgtatggctttatcggtgtttggtg

SEQ ID NO: 67493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaaggtctgcgtggttatagacacccatc

SEQ ID NO: 67494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaagtaacaacggtcaacggcgtacggag

SEQ ID NO: 67495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaagtatagtttgttattttcctgtgtaa

SEQ ID NO: 67496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaagtcggcccggccgtaagtcttgaggc

SEQ ID NO: 67497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaataattgacgtctttggccattgggcc

SEQ ID NO: 67498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaataccactaggtgtcggtttggatcga

SEQ ID NO: 67499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaatcacaaaaatagtgcccgatctggtg

SEQ ID NO: 67500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaatcgcgggtgagtgggggaacatggga

SEQ ID NO: 67501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaatgttctaatatttcccggagtagtgt

SEQ ID NO: 67502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgacaatagcataagaggggctgacaaccc

SEQ ID NO: 67503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgacactctccgacaatgttcataggagtt

SEQ ID NO: 67504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgacaggaatatgtgcaaatcgagttgatc

SEQ ID NO: 67505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgacaggaatttggctagagctcaaaaggg

SEQ ID NO: 67506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgacatcatggcctttcccgtggatctcgt

SEQ ID NO: 67507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaccaagggggccatcgtgcatacgtttc

SEQ ID NO: 67508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgacccagcagttagatagtggcgcttgca

SEQ ID NO: 67509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaccccccctttgagccatagagcgaggc

SEQ ID NO: 67510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaccgggtactgctagctcctgcctaacg

SEQ ID NO: 67511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaccgtagattcgaatagatgttaatgcg

SEQ ID NO: 67512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgacgcttttcttgacgcgtgacgggcgga

SEQ ID NO: 67513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgacggcggcgctacatcctatcatactgt

SEQ ID NO: 67514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgacggttctcgacacacggtgaagtaatg

SEQ ID NO: 67515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgactaacgggcgattctggactgatctgc

SEQ ID NO: 67516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgactacacatgtcacgtctttctgtgggc

SEQ ID NO: 67517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgactacgctaggtaggaggtgcaagcacg

SEQ ID NO: 67518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgactcctcggtgactgggtctataacgaa

SEQ ID NO: 67519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgacttcactcacagtattggtgcgtgtgg

SEQ ID NO: 67520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagagatcagaatgctgaccccaagacgc

SEQ ID NO: 67521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagagcgtaagttcgggtctattagttcg

SEQ ID NO: 67522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagcctttccttccgtttcggattggggt

SEQ ID NO: 67523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagcgagatctactttgcattatcataag

SEQ ID NO: 67524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagcgccgtgccatactatgcgtcgtgca

SEQ ID NO: 67525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagcgctcgccatgtcacgtaaccgttgc

SEQ ID NO: 67526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagcgggatgtgcattatgctatccgcaa

SEQ ID NO: 67527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagctaccactagtgtgtgcggaagtaag

SEQ ID NO: 67528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagctgaacatagtagggcgttgtctggc

SEQ ID NO: 67529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagcttgtcatgcatcccgagctacgatc

SEQ ID NO: 67530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaggaagcggttggttcttcttaagtgtg

SEQ ID NO: 67531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaggccgggcccggaccaatagccgtgca

SEQ ID NO: 67532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagggaattaaatgctcggttacctcagg

SEQ ID NO: 67533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagggcaggccagagaaaaccatgacatg

SEQ ID NO: 67534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaggggtacgtaacgttggggttgtcagg

SEQ ID NO: 67535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagggtatgccggagcgtaaaggctccga

SEQ ID NO: 67536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgaggtaatgggcctaaacaagtgataccg

SEQ ID NO: 67537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagtaaaacagtgagcggtgtttttacgt

SEQ ID NO: 67538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagtaactcgtgtctcacgattctccctg

SEQ ID NO: 67539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagtagctgcggtcaaacacctcgagcgc

SEQ ID NO: 67540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagtcttctgatgggccactccgcctact

SEQ ID NO: 67541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagtgctggtttgccgggttgggttgtgg

SEQ ID NO: 67542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgagttaagcctcgatggacctcaaaagtg

SEQ ID NO: 67543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatactggcctgttatcaagcttaagcgg

SEQ ID NO: 67544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgataggattcgatgatagggctaaccgcc

SEQ ID NO: 67545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgataggctgtcctgcgaattaggtcactg

SEQ ID NO: 67546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatatagagccagtagtcagtgataggct

SEQ ID NO: 67547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatatggcagcaagtgaatgagtgcaatt

SEQ ID NO: 67548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatatgtgactcctctgaattgcgacgta

SEQ ID NO: 67549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatcaagactgtgagcacgtcgtttaatc

SEQ ID NO: 67550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatcggtcgaatctctcttcggacggtct

SEQ ID NO: 67551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatgaacgtttaagccgcatgttggttcg

SEQ ID NO: 67552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatgaatttgacatcctgggtaacgcttg

SEQ ID NO: 67553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatgaccgcaacaggcacttgaaacagga

SEQ ID NO: 67554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatgcgtctgtaccactgccttccactat

SEQ ID NO: 67555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatggacggcagtcgaatatgtctgcgat

SEQ ID NO: 67556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgattcaggtttcctacctgcgagggtcat

SEQ ID NO: 67557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgattctagtaacgtaacgcctattttgtt

SEQ ID NO: 67558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgattctgtagtggtcgtcttctgcccctc

SEQ ID NO: 67559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgattcttaatcctaggtcttcactctggc

SEQ ID NO: 67560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgattggacattcgtggatcccaggcggct

SEQ ID NO: 67561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgatttgagatatggcgtggaaccttaaag

SEQ ID NO: 67562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgattttatgtgccctctccgtaagactca

SEQ ID NO: 67563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaacagaactgctgaactttggttcggt

SEQ ID NO: 67564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaacgccctgacaaacggccgtcaccgt

SEQ ID NO: 67565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaacgccgattttcacaacgcaacgctc

SEQ ID NO: 67566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaactcggacagtgacgcaaccgcgact

SEQ ID NO: 67567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaacttcttacttagcttagtatattcc

SEQ ID NO: 67568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaaggaattggtcaataagattggcatc

SEQ ID NO: 67569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaatcaagacatttcgcaaaggctcgcc

SEQ ID NO: 67570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaatgccgatgacagtcggacggcacga

SEQ ID NO: 67571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaattcctttactgcccttgtttagccc

SEQ ID NO: 67572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcacatgacgatctcgccgtattcccgta

SEQ ID NO: 67573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaccaccctgctcgtgcgactgtcgtta

SEQ ID NO: 67574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaccagaggcgactgtagagcgtctctg

SEQ ID NO: 67575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcacgacgagctgaacgatttgggctatg

SEQ ID NO: 67576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcacgattgattcgttatgtatttcccgg

SEQ ID NO: 67577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcacgccgttcttgtgaaccctggacgtc

SEQ ID NO: 67578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcacgggacgaatatccgaggatgtaaca

SEQ ID NO: 67579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcactaggacttcttctatggtcgcatgt

SEQ ID NO: 67580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcagaagagtgtccggcgttcagggttca

SEQ ID NO: 67581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcagatatcagccggacatgtcacgggcg

SEQ ID NO: 67582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcagcatatccgtgcattctagggttggc

SEQ ID NO: 67583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcagggacaggggatggccaacaggctcg

SEQ ID NO: 67584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaggggaaggacgcgtggatcacaccta

SEQ ID NO: 67585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcaggtaacttctgccccagtcatatccg

SEQ ID NO: 67586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcagtggcgcattcgctattaacatgcat

SEQ ID NO: 67587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcagtgtcagggggcgtcacgtccgaccg

SEQ ID NO: 67588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcagtttctggtatattccttgactaggg

SEQ ID NO: 67589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcatccgacacggtcatgtattccaattg

SEQ ID NO: 67590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcatgccgggttgttttttctgcgcgtcg

SEQ ID NO: 67591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcattaatcgcattacttcggaactggct

SEQ ID NO: 67592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccacaactctaagcgtcgggtacgggcc

SEQ ID NO: 67593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccacatatggtgctgtgcggtgttacgc

SEQ ID NO: 67594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccacgaccattccgtatcgtggggggcg

SEQ ID NO: 67595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccagagtccaagggaagggaactcgtca

SEQ ID NO: 67596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccagtacaaagcctcttacagcgggggg

SEQ ID NO: 67597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccagtgggtcctaatctcgacttcctgc

SEQ ID NO: 67598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccagtgtacaatccgccctgtgggttcg

SEQ ID NO: 67599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccattctagatgtcgattggggaaccat

SEQ ID NO: 67600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcccattttgaaggctgcatgaacctgct

SEQ ID NO: 67601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcccgaatccattctaaggatatgggaca

SEQ ID NO: 67602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcccgactcgatagtaactgtccgtctct

SEQ ID NO: 67603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcccgcctgcgtttccctgaccacttacc

SEQ ID NO: 67604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccctgaccgtctgctttattgacagtgt

SEQ ID NO: 67605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccgaactgttcggcttattgctgtccgc

SEQ ID NO: 67606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccgactggtagcagggcggtagtgcggg

SEQ ID NO: 67607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccgtttcgtccgcggctgtaagcattgc

SEQ ID NO: 67608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcctcgaccgacgatctgctcatttggga

SEQ ID NO: 67609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcctgaggatattctggtatagcccgtat

SEQ ID NO: 67610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcctgctgccgtaaaattcgaatacctcc

SEQ ID NO: 67611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgccttgcagcatggcgacgtccaggcagg

SEQ ID NO: 67612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgaaagatgttgtttgcagccccgagcg

SEQ ID NO: 67613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgaaatcgacctcgaactgagggatggt

SEQ ID NO: 67614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgaacgcagggatttctgggatttcccc

SEQ ID NO: 67615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgaaggacgtcgttgacgctgcgttgcc

SEQ ID NO: 67616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgaggtatagaagatataaggctttctg

SEQ ID NO: 67617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgcagaggtaattccggtcgtgagcgct

SEQ ID NO: 67618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgcagcgagttgccagttgatacgagcg

SEQ ID NO: 67619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgcagcgattagtcgagaccgccgcggc

SEQ ID NO: 67620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgcgcacaataaccttctcgagcgggtt

SEQ ID NO: 67621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgcgtgcctagctctatgctgctggcga

SEQ ID NO: 67622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgctcatcttccctagcttccgagggca

SEQ ID NO: 67623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgctgtattatttcgggggaatagttct

SEQ ID NO: 67624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggaaacaataccttcgtgaatcggctg

SEQ ID NO: 67625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggaagccagcatccttgtgtgcatggt

SEQ ID NO: 67626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggagaaagcttcggcgagtatgcagag

SEQ ID NO: 67627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggcaagtaggcgggttccctgtatccg

SEQ ID NO: 67628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggcaatctttccggcaatatccttctt

SEQ ID NO: 67629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggccgcatagagaagcggtgattgcgg

SEQ ID NO: 67630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggctctgccgacatgcggggccaagtg

SEQ ID NO: 67631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggctggaatacaacgtctggaggattg

SEQ ID NO: 67632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgggtgggctttttatacagtgtccttt

SEQ ID NO: 67633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggtaagcacatgggcgcttctttacac

SEQ ID NO: 67634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggtagctcatgtggctcagattccccc

SEQ ID NO: 67635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggtgagtgcacactgcaccgtgattgc

SEQ ID NO: 67636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcggttctgcgggttcgaactgtggttca

SEQ ID NO: 67637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgtcattatactccctgcccgctgcctg

SEQ ID NO: 67638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgtgcaatgctttcgaaattatcatggc

SEQ ID NO: 67639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgtggctttgctctttagcccatgtcac

SEQ ID NO: 67640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgtgtgggatgtgcgagacgaattgcca

SEQ ID NO: 67641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcgttgggttcttttcatgttaaccccgt

SEQ ID NO: 67642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctatagccgggatcgttctgattgctgc

SEQ ID NO: 67643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctccctttctacgatcggctccttcctt

SEQ ID NO: 67644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctcctgttagacttgacgaccggttaat

SEQ ID NO: 67645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctctaacccttttacttgccctatagca

SEQ ID NO: 67646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctgagttgctgttctgggcggtgggtca

SEQ ID NO: 67647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctggaacggggtctcgtacacgctgcgt

SEQ ID NO: 67648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctggccgtcgtgggctggaatctgtggg

SEQ ID NO: 67649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctggcctcgacccacttgcataagctcc

SEQ ID NO: 67650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcttaggaaggtttacttcaggttgggct

SEQ ID NO: 67651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcttcgcatgtgtaggccggtaagttccc

SEQ ID NO: 67652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcttcggatatacggcttctgttgtccac

SEQ ID NO: 67653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcttctccggggagcggacgttgctacgt

SEQ ID NO: 67654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgcttcttgtcacagagatatcgtttactt

SEQ ID NO: 67655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctttagcttgcttcggtttgctatacct

SEQ ID NO: 67656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgctttcgatgaactgcatccggagtgagg

SEQ ID NO: 67657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaaacttgtttggtcgatgcacgctcac

SEQ ID NO: 67658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaaagactcggtcatgctctccagggta

SEQ ID NO: 67659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaaagtcatactgaacaaagcccacaga

SEQ ID NO: 67660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaagatcgttataagacagcacgccgtg

SEQ ID NO: 67661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaaggatttcgggatcagacaacgccgg

SEQ ID NO: 67662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaatacggtcgcatccagtactcatcca

SEQ ID NO: 67663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaatcgtttcttaaagccttgagtagat

SEQ ID NO: 67664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggacacggtaccagcttcttcttaatgag

SEQ ID NO: 67665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaccaaggtgacaggttgactggaacgg

SEQ ID NO: 67666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaccgtacgatccctcagtgtggctgtg

SEQ ID NO: 67667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggacgaaagctccgaggataaccgttgag

SEQ ID NO: 67668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggacgctacccacaacggttcgcataccg

SEQ ID NO: 67669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggacggtggcgtgactttgtggtcgtggc

SEQ ID NO: 67670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggacggttatttctctctgttcatctatg

SEQ ID NO: 67671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggacttaccataggattacgcacaattag

SEQ ID NO: 67672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggacttgctttttttttctaggcggttag

SEQ ID NO: 67673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggagcgtttagctgggacaagtgtcaaat

SEQ ID NO: 67674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggaggaaggcctgttgacggacatccttg

SEQ ID NO: 67675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggagtcaagcgggagcgaacatcccccaa

SEQ ID NO: 67676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggatcgttggtcgtttaaaccaatctgtc

SEQ ID NO: 67677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggatgatcagattgtaaggcttcgactat

SEQ ID NO: 67678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggattggcgacttatcttgtacaagcggg

SEQ ID NO: 67679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcaaccagacgtccacgaagttcccatg

SEQ ID NO: 67680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcaatagatgcaagtctggcaccgacgg

SEQ ID NO: 67681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcaatccggcttgacagcttgggcgcgc

SEQ ID NO: 67682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcacccggctttggggctagaagggccg

SEQ ID NO: 67683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcaccggggccagtacaacgtgggtgtc

SEQ ID NO: 67684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcacgtacgaggggtccatgacatagcc

SEQ ID NO: 67685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcacgttggctaggcaaatcgtggttgt

SEQ ID NO: 67686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcaggtaaccagttgatgaaggctgggc

SEQ ID NO: 67687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcaggtctttaggtaacgggtcgacaac

SEQ ID NO: 67688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcagtcaaggtctccagagattcgctct

SEQ ID NO: 67689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcatgactctagacctcgcgacgcccgg

SEQ ID NO: 67690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcatgtgacacgctttccatgtttgtcg

SEQ ID NO: 67691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcattcgccttgtgttttggcaactttg

SEQ ID NO: 67692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggccagtgtacgagagtgtgcggctgtag

SEQ ID NO: 67693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcccgctctgaccaatgggttgcgaacg

SEQ ID NO: 67694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcccgtagcgagaccttggcgtctactg

SEQ ID NO: 67695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggccctgctttattgattgtgctcgcgtg

SEQ ID NO: 67696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggccgatttatgtagaatatctctcggat

SEQ ID NO: 67697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggccggcaatcctatccttacttcctgcg

SEQ ID NO: 67698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcctcccgtcaagtctagctcaagggcc

SEQ ID NO: 67699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcgaaagggaggtgggtggatgcacctt

SEQ ID NO: 67700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggcgtgttaaatacgacagttagtttagg

SEQ ID NO: 67701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctaaggtgtcgaacaatccgtttttgt

SEQ ID NO: 67702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctaccgagggaagataagacccgaggg

SEQ ID NO: 67703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctaggcaatcgagctatccactacgca

SEQ ID NO: 67704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctatcgatgggcgagtcccgttttcgc

SEQ ID NO: 67705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctattgatacagttgagttgaggccgc

SEQ ID NO: 67706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctccgcatttcgaggatgaagcgaaga

SEQ ID NO: 67707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctccgggtatcgtggggtcagtagtgg

SEQ ID NO: 67708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctctggtgttgcatacgagactggtgc

SEQ ID NO: 67709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctgacaactttgacgtcaagcgctgtg

SEQ ID NO: 67710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctgtggggtggccgaactaacaaactc

SEQ ID NO: 67711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggctgtggttttttaaattaaaagctgtg

SEQ ID NO: 67712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggaagaaggcccggaaaaccccttctgg

SEQ ID NO: 67713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggaccgcgtgttagagttatgagttctg

SEQ ID NO: 67714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggacgacacagctgcggtgtcaagtgtt

SEQ ID NO: 67715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggagcttcgttttcgcactctggtttga

SEQ ID NO: 67716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggagtcctacaggttcggaactcggggc

SEQ ID NO: 67717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggatgcaaacctcgtcgaagtgttgttc

SEQ ID NO: 67718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggcagtatcgggcgtttaccatcgagcg

SEQ ID NO: 67719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggcatcgaagcgcgtgccctagtcggat

SEQ ID NO: 67720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggccaccgaatttggcttcgttggcagg

SEQ ID NO: 67721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggccattcgtcagacttcggccgcaggt

SEQ ID NO: 67722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggccggaacaggccaagtcgagtaccgg

SEQ ID NO: 67723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggcgccggatctatgacgtgtgttggcg

SEQ ID NO: 67724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggcgctattacagtgggcgtattggaat

SEQ ID NO: 67725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggcgtaggtgattagtgacgctgtgggc

SEQ ID NO: 67726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggcgtggataaggctaaacaggttcagc

SEQ ID NO: 67727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggctatatttgtacgactatgtggccgt

SEQ ID NO: 67728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggctcgttccactgcgcttgggaacgtg

SEQ ID NO: 67729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggcttcgacggccactgtcaaagcatcg

SEQ ID NO: 67730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggggaaatcttagtctcactgtatccctt

SEQ ID NO: 67731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggggaatgggctttcggtagtctgtcccg

SEQ ID NO: 67732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggggagggggattgtgagtgcgtcgcgtg

SEQ ID NO: 67733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggggaggggggtgacaattgtctattgct

SEQ ID NO: 67734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggggctatccaacttgcgtccctcataca

SEQ ID NO: 67735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggggatatggaccgtactcgagacatgt

SEQ ID NO: 67736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggggttatcgtcagctatggattggtgga

SEQ ID NO: 67737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggtaagggacaggtcatgtttaaggcct

SEQ ID NO: 67738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggtaattgtgttcctcaacatggggcta

SEQ ID NO: 67739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggtaggatatcgaaatccccaggcagcg

SEQ ID NO: 67740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggtagttgcctgggtcggttcgtgggga

SEQ ID NO: 67741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgggtgatcgtgcgatatccgggttttctt

SEQ ID NO: 67742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtacgaacgttcacaacattgccgtctt

SEQ ID NO: 67743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtacggttcctctcagtccgttttgcca

SEQ ID NO: 67744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtaggggatctggtcgggtccaggcttt

SEQ ID NO: 67745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtaggggtccaatcagccttatccttac

SEQ ID NO: 67746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtagtgcgcgatacatattggccagcgc

SEQ ID NO: 67747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtatgacactgggatactgtaggtcatt

SEQ ID NO: 67748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtatggaaggcgcgtgttagggtaggac

SEQ ID NO: 67749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtatttcaacgataattaactatagccc

SEQ ID NO: 67750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtcagcgggcgggacaacgacggtgttc

SEQ ID NO: 67751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtcatgggtcttgcttacggagccctct

SEQ ID NO: 67752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtcgcggaggcatgaaactactcgacct

SEQ ID NO: 67753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtctagtgtgatttggtactcctggtag

SEQ ID NO: 67754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtctcggacagtgatcctgcaggcctga

SEQ ID NO: 67755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtctgcccttcttcggtgactgaaaggg

SEQ ID NO: 67756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtctgctggcgactgctgatagctgttg

SEQ ID NO: 67757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtgaaacttgctgatcgatgtcgccctc

SEQ ID NO: 67758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtgatcctaacggcgcttaaagaaggct

SEQ ID NO: 67759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtgcagttgggcagggtcctggtggatc

SEQ ID NO: 67760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtgcatgtgcatgcttctaccttcaagt

SEQ ID NO: 67761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtgggggccgtaagataagcatcagttt

SEQ ID NO: 67762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtggtgatagtggtgtgtatgatgtagt

SEQ ID NO: 67763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtgtccctgcgtcgggctatgtgtatca

SEQ ID NO: 67764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtgtgctaatgcaagtacttgcactctg

SEQ ID NO: 67765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggttagtgtagcctgacgggagacacggg

SEQ ID NO: 67766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggttcctttaacaaccactatggggcgtg

SEQ ID NO: 67767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggttggctggtagttaagggacacacgag

SEQ ID NO: 67768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggttgggacgtcatagcgcttttggttgg

SEQ ID NO: 67769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggttgtagtggggctaacttagatggtag

SEQ ID NO: 67770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggtttatcactgtgcccactagaatcgtc

SEQ ID NO: 67771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggttttccgacacaagactaatagatctg

SEQ ID NO: 67772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcggttttgtgagtcataacccaggtacact

SEQ ID NO: 67773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtaaacggtcaaaaacggacaccgatctc

SEQ ID NO: 67774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtaacgcttgattcgtttagggggaccaa

SEQ ID NO: 67775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtacaccatggccgtcccttctgtcgatc

SEQ ID NO: 67776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtaccgtcatttaggacctcttgacggct

SEQ ID NO: 67777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtacgggtccccgtggtttaggtttacgc

SEQ ID NO: 67778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtacggtcttgtcgcaagggttttgtcca

SEQ ID NO: 67779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtactaccttaccgagagacgagcaccgg

SEQ ID NO: 67780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtactgaatgcaggtttgcccattaatag

SEQ ID NO: 67781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtactgtccacgagggtattggctcctgg

SEQ ID NO: 67782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtaggcagggcacgccaaccccctccatc

SEQ ID NO: 67783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtaggccccgacgatcgagagccgtgctg

SEQ ID NO: 67784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtaggcggagtcaccggtcgaggggccac

SEQ ID NO: 67785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtagggccaggcctttcattgcgctcccc

SEQ ID NO: 67786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtatacggatctgtaagggtgtttatcgg

SEQ ID NO: 67787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtatattcccataccttgcctaggttctc

SEQ ID NO: 67788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtatcactggtggatcttggggcgagatt

SEQ ID NO: 67789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtatctgatccaggccttatccttcgatg

SEQ ID NO: 67790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtatggctggggtgtcgatccgtgttaaa

SEQ ID NO: 67791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtattattcgtttgggcgttagatctgtc

SEQ ID NO: 67792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcacggcgcccatctgaccttgacgtct

SEQ ID NO: 67793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcactcgcgtccagtactccccatgcgg

SEQ ID NO: 67794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcactctcgcgatcaagatcattgatct

SEQ ID NO: 67795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcagatgaaaggccgtcctttcacaagt

SEQ ID NO: 67796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcaggactcacggatctgatagtgctcg

SEQ ID NO: 67797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcaggcagcttatacgttttgtgtacgt

SEQ ID NO: 67798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcaggctgcattatttgacagggacaac

SEQ ID NO: 67799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcattcttcctttcccacccgttgagga

SEQ ID NO: 67800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcccagtgtcgcaggctatgatcgggaa

SEQ ID NO: 67801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtccggaagtgctggtccaacgactcctc

SEQ ID NO: 67802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtccggtactccctaacgttcccgaccat

SEQ ID NO: 67803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtccgtccacagagcggttgggaggctca

SEQ ID NO: 67804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcggacttcggtgtccatcgcggtggat

SEQ ID NO: 67805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtctgaaccggatgccgtccgggcgggtg

SEQ ID NO: 67806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtctgcgaatagctgctacaagcgggagg

SEQ ID NO: 67807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtctggcatgtttggaccaaggcacttta

SEQ ID NO: 67808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcttaagcctagtcgtcccacgcacgcg

SEQ ID NO: 67809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcttagacatgtcagcaagcgatgtacg

SEQ ID NO: 67810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtcttgagccgacgtcacgtcgcttacgt

SEQ ID NO: 67811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgaccaacggttcgtcgagtgagtagta

SEQ ID NO: 67812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgacgaacgatccatcgaagtgggggac

SEQ ID NO: 67813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgacgactgtaccatgacaaggattaac

SEQ ID NO: 67814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgagcatacgccattgggatttgacgtg

SEQ ID NO: 67815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgagtacgtctgcatatcgggtaatgtt

SEQ ID NO: 67816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgagttgggctgcggaagttggtagtcc

SEQ ID NO: 67817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgatgctcgatacgcctttaagcccctt

SEQ ID NO: 67818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgcaaggcgcgctaacggacttgtatcc

SEQ ID NO: 67819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgcagggctgggttgccctaaccgcgag

SEQ ID NO: 67820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgccacctcagcattagtattaggaatc

SEQ ID NO: 67821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgcccgagctagaaacaatgagtagtcc

SEQ ID NO: 67822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgccggcgcaaagggcagaggtggaacg

SEQ ID NO: 67823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgccgtttcctgtgatgtggcagtacgg

SEQ ID NO: 67824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgcgaaggtatcttcatccgcgtagggc

SEQ ID NO: 67825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgcgtctcgttatcacgtttcaaagttc

SEQ ID NO: 67826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgctgcgcgttggaaggttgttgtgatg

SEQ ID NO: 67827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgcttgctgtctgcttgaatccgcggtc

SEQ ID NO: 67828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtggcggatattccatatacgcgatcctc

SEQ ID NO: 67829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgggcccctgtcccaaagacccgtctcg

SEQ ID NO: 67830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgggggaggtgttccgtcgctttgggca

SEQ ID NO: 67831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtggggtgaccgtatgccctggttgagga

SEQ ID NO: 67832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgggtgggacggggtgtcataggtgcac

SEQ ID NO: 67833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgtgaccggtaaaggttaggctgcggag

SEQ ID NO: 67834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgtgcaaggggctgtagtatgtgcgggc

SEQ ID NO: 67835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgtggttatcaggtcgggcaagactttt

SEQ ID NO: 67836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgtgtcgccacctcatgcttgcgtttca

SEQ ID NO: 67837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgttgcgcttgtgttaggatccctggcg

SEQ ID NO: 67838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgttgtagtattcaaatgtgggaacctc

SEQ ID NO: 67839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtgtttactcgagccggaccgtttagcgc

SEQ ID NO: 67840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttacaagcggacttgggtacctggtcac

SEQ ID NO: 67841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttagccacggagccgcagatcgattgcg

SEQ ID NO: 67842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttagttgaaccatacacgcggagatatg

SEQ ID NO: 67843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttcaaccgtgtttggcgacctgttcgcg

SEQ ID NO: 67844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttcaggatgggtcagtcctgcccccgct

SEQ ID NO: 67845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttcatgttatttctagttggccgtcaaa

SEQ ID NO: 67846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttcccgagttttggtatcacaccaacgg

SEQ ID NO: 67847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttcgacgtgctagcttgctcgtttgttg

SEQ ID NO: 67848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttctggggacgggttcagcactcgcttc

SEQ ID NO: 67849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttctgtggcccgtggattgtacgtcctc

SEQ ID NO: 67850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttgagtctgccgataagagagctcgtgg

SEQ ID NO: 67851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttgatatcactggtcacaaatagcgatc

SEQ ID NO: 67852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttgcccgcgtggtcgtttattagcgagt

SEQ ID NO: 67853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttgcttaactggtttagttgcgtatgcc

SEQ ID NO: 67854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttggagcctgtcggttactgtcaagacc

SEQ ID NO: 67855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttggcgtctgttccatcatcgttgactc

SEQ ID NO: 67856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttggtgccttcccgatatcttagcacgg

SEQ ID NO: 67857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttgtcaatcgattaggtcgctgacacgc

SEQ ID NO: 67858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgttgtccaagtctcgacacgtggtactct

SEQ ID NO: 67859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtttacggggtccggcggtggtgcggtct

SEQ ID NO: 67860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtttccacatcgctcctttgagggcctcc

SEQ ID NO: 67861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtttccttccctggcattcggatatcatc

SEQ ID NO: 67862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtttcttagtcgattctgttatgggaccg

SEQ ID NO: 67863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtttgaagagccttggaattgcgatgata

SEQ ID NO: 67864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtttggaacgctcatgtgttaactccgga

SEQ ID NO: 67865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgcgtttggccctgggagtcttcgcgtagaga

SEQ ID NO: 67866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaaacctgtcatgaggctacgaaacgtcc

SEQ ID NO: 67867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaaacggcatcttctggtagtcaactacg

SEQ ID NO: 67868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaacacgaggcgcccattcttcggaggat

SEQ ID NO: 67869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaacatcgaccagcgagcggcgtggacat

SEQ ID NO: 67870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaaccactcgtgatctggtggtgatccgt

SEQ ID NO: 67871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaaccccacatatggccaaactggtgcgc

SEQ ID NO: 67872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaacggaagccgcgtctgaggtccgggga

SEQ ID NO: 67873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaacttccatatggcgcagtcactcgggg

SEQ ID NO: 67874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaagaacattgctgtgcggatgattggtg

SEQ ID NO: 67875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaagcgctgcgatcctaggcacgtccctt

SEQ ID NO: 67876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaagtcagaactcaactagtgcacaaatg

SEQ ID NO: 67877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaatgtactaccgtcaactggttatacct

SEQ ID NO: 67878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacaatgcgcactctttcaatgaaccgtt

SEQ ID NO: 67879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacaatgtgctcgaaatcgttccctaccg

SEQ ID NO: 67880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacacaggtactacaagctgttgctggtt

SEQ ID NO: 67881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacactggcacagaatactcttcacaaaa

SEQ ID NO: 67882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacactttatatgtctttgaacgtctgga

SEQ ID NO: 67883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacagagtgacacgaaaattccgtggtcg

SEQ ID NO: 67884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacatgtgtcttttggtccgcctcatacg

SEQ ID NO: 67885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacattgtaacataagggaccgaaacacc

SEQ ID NO: 67886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaccaaactgtatcgaggccgaaagaggg

SEQ ID NO: 67887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacccgactaaatgccaagtatcgccctt

SEQ ID NO: 67888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaccgtaaggttttcacaggcgcaggagg

SEQ ID NO: 67889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacctacgccgttgactgttagagcattc

SEQ ID NO: 67890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaccttacaccagttaaagtacataggtc

SEQ ID NO: 67891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacctttagcctgccttgatttactgcac

SEQ ID NO: 67892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacgaaggcacggaaatcatgtgctattc

SEQ ID NO: 67893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacgccggttcaataggttggtcgggcgc

SEQ ID NO: 67894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctacgtgtgttccgcgttgtggatgttggt

SEQ ID NO: 67895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctactaaccgtgtatcctggtcgggtccca

SEQ ID NO: 67896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctactcaggttaccttccttctggcgttat

SEQ ID NO: 67897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctactcgttggtgagtttcaggcacatgat

SEQ ID NO: 67898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagacgacgtattgctattccatggggta

SEQ ID NO: 67899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagagattcccaggctaagttggccccgt

SEQ ID NO: 67900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagatctgttcgtacatttctacattctt

SEQ ID NO: 67901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagccgggaatcctgcatgtgcagttcga

SEQ ID NO: 67902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagccgtataataccgagtacaaggttgc

SEQ ID NO: 67903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagctttcatatgttctgccgttttatcg

SEQ ID NO: 67904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaggtatccagactccttgcgtcaccttc

SEQ ID NO: 67905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctaggtgctcttattaattaaaatcagtag

SEQ ID NO: 67906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagtaacccaggttttttctattttcgcg

SEQ ID NO: 67907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagtagctactattttgtgccattccgtt

SEQ ID NO: 67908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagtcgctgacaatactgtgcccggcagg

SEQ ID NO: 67909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagtctgtgcaaaacgtcgggtcgcacgt

SEQ ID NO: 67910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctagtgatatcgcgcgggtcacttgtcatc

SEQ ID NO: 67911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctataactcgattgggccggtgttttattg

SEQ ID NO: 67912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctatatgttcttctcctctggaggtttccg

SEQ ID NO: 67913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctatccagttcatgtgctattcgtacgttc

SEQ ID NO: 67914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctatcctactcgctgttttagttttcgtcg

SEQ ID NO: 67915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctatcttgagacgaatcgtccttggcctgg

SEQ ID NO: 67916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctatgccgccaccaggcatttttgtggtgg

SEQ ID NO: 67917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctatgtgcatcattccggctctgacaagga

SEQ ID NO: 67918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctatttgtcctcacacatgcgtcggcgtta

SEQ ID NO: 67919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcaattaccttgtatcgctgcgggttcac

SEQ ID NO: 67920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcacaccgcgtgaccagcggattcccgca

SEQ ID NO: 67921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcaccttttaagggttcagcgtgttatag

SEQ ID NO: 67922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcacggggcggttctaggttcgaccacaa

SEQ ID NO: 67923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcacttcgcggtgagttagacccgaggta

SEQ ID NO: 67924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcagataggggacagcgagggagcgggta

SEQ ID NO: 67925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcaggaaaggcctggttgtgtatgttttg

SEQ ID NO: 67926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcaggccttcatcttgtatggagccgtcc

SEQ ID NO: 67927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcaggggggtgcgaggcgtgctgcccgat

SEQ ID NO: 67928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcatatgttaactacaccgtaatccatgt

SEQ ID NO: 67929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcatcttggcagtggctaatacgtcatgc

SEQ ID NO: 67930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcatgccacacgtcgcctgcatgacctgg

SEQ ID NO: 67931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcatgcgtagacgaaactggccaatagcc

SEQ ID NO: 67932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcattgatcgggagacggggatatgcgtg

SEQ ID NO: 67933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccacgaaatcgtcggatcatgtggtact

SEQ ID NO: 67934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccactcagcagaaatataaatgggggac

SEQ ID NO: 67935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccaggcatggctataatcggttttgttc

SEQ ID NO: 67936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccaggtatggtacgtccatctaccaccg

SEQ ID NO: 67937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccatgttctaaactcgagtagctcactc

SEQ ID NO: 67938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcccattcatgtttttaatcgtggcgggt

SEQ ID NO: 67939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccctaatcgtcatggcgggctgtctgtt

SEQ ID NO: 67940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccctagtctagttggttgtgtgttgggc

SEQ ID NO: 67941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccgaccaaaagcgtcaatgccgtatgcg

SEQ ID NO: 67942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccgcgccaaacccatcttaagccgtccc

SEQ ID NO: 67943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccgcgttaactggaggatacattctacc

SEQ ID NO: 67944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccggcgtggttaacacatggactgtgct

SEQ ID NO: 67945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcctagcgatgctgccttgatgctcttgg

SEQ ID NO: 67946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcctgactcgtgttcctatcggcaattat

SEQ ID NO: 67947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctccttcctatcactttgggggtggtggat

SEQ ID NO: 67948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgaacgtcagtccacgttgcggtggtgg

SEQ ID NO: 67949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgacgggccatgaccgacgtgtagttgc

SEQ ID NO: 67950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgactaatgctgggcttcgaccggtggt

SEQ ID NO: 67951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgaggcagttctgttttgcgtgccgcgg

SEQ ID NO: 67952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgatgaacattgctgcgaggcgtcttgt

SEQ ID NO: 67953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgatgccaacaaagtgtaacctccgccg

SEQ ID NO: 67954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgcaaagatccccgggtgcctgatggtt

SEQ ID NO: 67955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgcctgtatcattagcacagactctccg

SEQ ID NO: 67956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgcgggtagttcccctaacaccttggtg

SEQ ID NO: 67957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgctaccaccatttgaacccctgtccca

SEQ ID NO: 67958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgctcgcgcgatttttcgtggttcggct

SEQ ID NO: 67959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcggaggataatgggatggtttttaatcg

SEQ ID NO: 67960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcggatcccttgcttgagtcagtaggtcc

SEQ ID NO: 67961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcggctaatttggtttggtagctggagtt

SEQ ID NO: 67962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgggacttcagtacgtcgtcaggggtgt

SEQ ID NO: 67963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcggggagacacaatcgggctattgggtg

SEQ ID NO: 67964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgggtcgagcgcactcggctctatccac

SEQ ID NO: 67965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcggtacacccgattgcagaaagcgcagc

SEQ ID NO: 67966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcggttagggcgggagctagacataacct

SEQ ID NO: 67967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgtcatcaggaggtgtttccctcgtccg

SEQ ID NO: 67968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcgtcatttgtacgcgtagtaagtagtac

SEQ ID NO: 67969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctaacgctactgtatctcagctcaccgc

SEQ ID NO: 67970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctaagagcatgcacattaacggcggtct

SEQ ID NO: 67971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctagttatgacgttcagacttttttccg

SEQ ID NO: 67972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctcaatggtcccgcaagtggactcttcc

SEQ ID NO: 67973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctcagaggcatgcgtatcgattgcccat

SEQ ID NO: 67974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctcatgtttatgatatttggtctgcttc

SEQ ID NO: 67975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctcgcgcctacatgacttctctgactct

SEQ ID NO: 67976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctcggttaccttcggttggtgtccgaat

SEQ ID NO: 67977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctcgtggtgctcgggtgtttgcgctccg

SEQ ID NO: 67978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctcgttgccaaaagtcggtttgagtgaa

SEQ ID NO: 67979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctgagttccggtcctcattccctccgca

SEQ ID NO: 67980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctgcgtgcacgattaatcctcttgttgg

SEQ ID NO: 67981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctggttcgttcgaacggggatgtgcaac

SEQ ID NO: 67982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctgtgcttgttcactgcaagtggaacgt

SEQ ID NO: 67983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcttgataaaagtaaacgagctgatgaac

SEQ ID NO: 67984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctttacttcccgtttcgctcttaataac

SEQ ID NO: 67985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctctttgcttatctcgtaataggttgcctc

SEQ ID NO: 67986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctcttttgtctacaggctatttcttgaggt

SEQ ID NO: 67987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgaaccacaccgtgattttcgggttggca

SEQ ID NO: 67988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgaaccgtcctgcagttctcacttttgcc

SEQ ID NO: 67989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgaagacccggtgtcagctagggggtacc

SEQ ID NO: 67990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgaagtcaagactggccggttgcgcgctt

SEQ ID NO: 67991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgacacaatcgttggcggtggtggtgctt

SEQ ID NO: 67992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgacacgatccgtaagttggaccgtagtt

SEQ ID NO: 67993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgaggaacgtttctcctctcggcaatagc

SEQ ID NO: 67994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgaggactatagacccttcgctaactagg

SEQ ID NO: 67995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgaggactgtactggggctggttatcggg

SEQ ID NO: 67996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgaggatgtgttattacgcgataaccgtt

SEQ ID NO: 67997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgagtccgtgtggtacggatactcctcat

SEQ ID NO: 67998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgagtcgacgctaactgtcttgcggaatg

SEQ ID NO: 67999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgatacgaagtaccacattccatctgacg

SEQ ID NO: 68000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgatcatttgaatccctgattaatacacg

SEQ ID NO: 68001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgatgccggagtggcagagagctcggcga

SEQ ID NO: 68002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgattctccgtcctggtcaagagatctag

SEQ ID NO: 68003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgcaaatcgttaaattcagatccgggcct

SEQ ID NO: 68004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgcattcttggccgtaacgcgtaagcgcg

SEQ ID NO: 68005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgccatggcttccgagttaatgtggcgga

SEQ ID NO: 68006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgccgtcgcgagtccttgagttgtggcat

SEQ ID NO: 68007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgcctctcggaacattttgcatctattcc

SEQ ID NO: 68008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgcctgtaccattgagggttccaaacggt

SEQ ID NO: 68009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgccttgttcttcgcgaatctcactaagc

SEQ ID NO: 68010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgcggccgagtcttctgcaatcttggcga

SEQ ID NO: 68011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgctgcggctgcttgttatacgagatttt

SEQ ID NO: 68012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgctggggtgtcacaagtctctgttcccg

SEQ ID NO: 68013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgctgtactatgattgttattctgcgggt

SEQ ID NO: 68014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgcttatttcccttgtcggttccgtgggt

SEQ ID NO: 68015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgcttcatcttgcatcccatgctccttgt

SEQ ID NO: 68016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctggatccgggttaactcagcgctgctggc

SEQ ID NO: 68017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctggcatcctctggcatttttttacgcgtt

SEQ ID NO: 68018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctggcccgtctttcgcgaatcgcttaagtg

SEQ ID NO: 68019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgggacggagtgcgtcatcattagggctt

SEQ ID NO: 68020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
tgctgggatcggtctaagccaggtcgtgttct
